United States Patent 11,446,398 (REGULATED BIOCIRCUIT SYSTEMS) - sequence listing, part 36

SEQ ID NO: 121719 - DNA, 3225 bp, Homo sapiens
  Payload ID: 3864
  Gene Symbol: COMMD4
  Gene Name: COMM domain containing 4
  Uniprot ID: Q9H0A8
  ENST ID: ENST00000480484
  CDS Start-End: 15-614
ggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaagtagagatgaggtttctccatgttggtcaggctggtctcgaactcctgacctcaggtgatccacccaccttgccctcccaaagtgctgggattacaggcgtaagccactgcgcccagccactgccatcatctttaggaagagagaagtgaccatgcctgaaccagtcattggcaagaggaacggtgttatggactgaatgttcatgttcctccagaattcatatgctgaagcctctgtccacacatgcacaccagatgagggccatgtgcgcacacgaggtggctgtctacaaggccagaaagagggctgtcaacaggaactgcgtctgctggcaccttgatcttgaacttcccagcctccagaactgtgagaaagaaatctctatggtgtaagccactagtctgtggcattgttatagcagctcgagaagactaaggcagatgggcttccaggactggcccagaccagccagggctccttgtagaaaaggctgatgccagggttggcacatggagggtacaaggaggactcgcctggagtatcttaaggaacctatcgaagaataatggcttgttccactggccaaagatgggacaatttgaacatcaaaagagatacttactgactccactcctgacttctgcttctgaaaaaatgaagtaggtgttttccctattcctcccactaagtacagttaacaaccctggatgttacatataaaacaaacaaaaagactccgagcgatggagagaaggcaccctagcctggctgggatcctcaggacctgaggctccacagagagaaattcctggaatctggaccccatggcccagtcaggttacacaaaactgatcatcacagatctgtagaactatacaaaagtgctaacattcatgattagggtctcagaaggtaaggaggaagagagtggaatggaaaaagtattcaaaaaaataatcactaaaggccaggtgcagtggcccatgcctgtaatcccagcactttgggaggtgggacaattgctttagaccttgcaactggcctgagcaacacagggagactcagtttctccaaaaaaataaaaaattagccgatcatggtggtgcgtgcttatagtctcagctactcagaaggctgaggcaggaggatcaatcgcttgagcccaggggtttgaggctgcagtgagctgtgatcatacctctgcactccagcctggataacagagctgagaccctgtctcaaaaaaaaaaaaaaaaaaaaaaaaaaaatgtatatatacacacattggaatatttttcagcccttaaaaagcagaaggttctgtcatttgtgacttggatgaacctagacgacatgatgctaagtgaaataagccaggcacagagagacaaatacctcgtcacctcacttatgcctggagttgaaaaaagggcctggggcagtggctcacgcctgtaatcccagcactttgggaagccaaggtgggaggatcacttaagcccaggagttcgagaccaggctgggcaacatggcaaacctgtctctacaaaaagtaaaaaaattagccgggtgcagtggcacatgcctgtggttccagcacttgggaggttgaggtgggaggattgcttgagccagggcggtcaaggctgcagtgaaccatgatagtgcccctgcactccagcctgggtgacagtgagaccctgtctcaaaaaaaaaaagttaaattcatagaagtcgacagtagaatggtggttagcagaggctggaggagagagagggtgggttgtggggaaaaggggagacaccggtcaaaaggtacaaagttccagttaggaggagtacattctggtgatttattgcccagcgtggtgaccagttaataatgatgtatacttcaaaatagctaaaagagggttttaaatgttctcatcacaaagaaataaatatttgaggtaatggatatcctaattagcctgatttgatctttttttgtgttttttgttttcttgagacagagtctcactctgttgcctaggctggagtgcagtggcgtgatcttggctcactgcaacctccgcctcccgagttcaagtgattctcctgcctcagcctctgtagtagctgggactacaggcatgcaccaccacccctggctaattttttgtattttttgtagagactgggtttcactatgttggccaggctggttttaaacttctgacctcaggtgatccgtctgcctcggcctcccacagtgctgggattacaggcatgagccaccgtgcccagccgatttgatcattccacaatatatgcatgtaacaaaacatcacactgtactccataaatttatacaattattatttgtcaattaaaaataaaactatagataagtc

SEQ ID NO: 121720 - DNA, 666 bp, Homo sapiens
  Payload ID: 3864
  Gene Symbol: COMMD4
  Gene Name: COMM domain containing 4
  ENST ID: ENST00000568301
  CDS Start-End: 34-666
gggcgaagcgaggcttgggctgctggagcgggaatgagggggcgccaagtggctccggaaactgggggaggttgtactggcctctccgcaaacacagtgtgtgcgggcgtgagggctaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctc

SEQ ID NO: 121721 - DNA, 639 bp, Homo sapiens
  Payload ID: 3864
  Gene Symbol: COMMD4
  Gene Name: COMM domain containing 4
  ENST ID: ENST00000564815
  CDS Start-End: 38-571
ggaaaaagaaattcccgggccctggcttcttggcgcgatgaggttccggttctgtggtgatctggactgtcccgactgggtcctggcagaaatcagcacgctggccaagatgtatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctc

SEQ ID NO: 121722 - DNA, 461 bp, Homo sapiens
  Payload ID: 3864
  Gene Symbol: COMMD4
  Gene Name: COMM domain containing 4
  ENST ID: ENST00000567377
  CDS Start-End: 52-461
gcgatggtgaggcactaggggcgaagcgaggcttgggctgctggagcgggaatgagggggcgccaagtggctccggaaactgggggaggttgtactggcctctccgcaaacacagtgtgtgcgggcgtgagggctgtgagtctgtatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcc

SEQ ID NO: 121723 - DNA, 746 bp, Homo sapiens
  Payload ID: 3864
  Gene Symbol: COMMD4
  Gene Name: COMM domain containing 4
  ENST ID: ENST00000562789
  CDS Start-End: 40-480
cactaggggcgaagcgaggcttgggctgctggagcgggaatgagggggcgccaagtggctccggaaactgggggaggttgtactggcctctccgcaaacacagtgtgtgcgggcgtgagggctgtgagtctgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaagg

SEQ ID NO: 121724 - DNA, 850 bp, Homo sapiens
  Payload ID: 3864
  Gene Symbol: COMMD4
  Gene Name: COMM domain containing 4
  ENST ID: ENST00000562610
  CDS Start-End: 37-369
gaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaagg

SEQ ID NO: 121725 - DNA, 544 bp, Homo sapiens
  Payload ID: 3864
  Gene Symbol: COMMD4
  Gene Name: COMM domain containing 4
  ENST ID: ENST00000567720
  CDS Start-End: 30-188
aaattcccgggccctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgatgatccaggctgggggtgaggggctggtgagcaggggcctggcaccccctgaaggtctcctttccccatagtatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaat

SEQ ID NO: 121726 - DNA, 677 bp, Homo sapiens
  Payload ID: 3864
  Gene Symbol: COMMD4
  Gene Name: COMM domain containing 4
  Uniprot ID: Q9H0A8
  ENST ID: ENST00000567195
  CDS Start-End: 71-412
cgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaag

SEQ ID NO: 121727 - DNA, 1373 bp, Homo sapiens
  Payload ID: 3865
  Gene Symbol: COMMD5
  Gene Name: COMM domain containing 5
  Uniprot ID: Q9GZQ3
  ENST ID: ENST00000305103
  CDS Start-End: 254-928
ggcccgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgagg

SEQ ID NO: 121728 - DNA, 1305 bp, Homo sapiens
  Payload ID: 3865
  Gene Symbol: COMMD5
  Gene Name: COMM domain containing 5
  Uniprot ID: Q9GZQ3
  ENST ID: ENST00000402718
  CDS Start-End: 133-807
cggaagtggctctcagggcgcttccggggaccaggcccgcttttggctgcatcagccggggattgccggcgccaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaatagctcatca

SEQ ID NO: 121729 - DNA, 1573 bp, Homo sapiens
  Payload ID: 3865
  Gene Symbol: COMMD5
  Gene Name: COMM domain containing 5
  Uniprot ID: Q9GZQ3
  ENST ID: ENST00000450361
  CDS Start-End: 423-1097
agttttattgggctataattcacataccatataattcacccattttgtacaattcaatgattttggcatattattttttaactatggtaaagtacatgttaaataaaatggctcggccattgtttcggaccgagctcctgcgctagggcccaacagagcagcccaaagcggaaccgagtcacgcgcgccggacgccacccgacaggaggggaaacggggcagctctcaaaaccctggaggcgcagaccgtccacacgggacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaa

SEQ ID NO: 121730 - DNA, 848 bp, Homo sapiens
  Payload ID: 3865
  Gene Symbol: COMMD5
  Gene Name: COMM domain containing 5
  ENST ID: ENST00000533270
  CDS Start-End: 336-848
gccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggtaggttggccccgaaccgtgggggcggcgacggccgagtgccaatttgactctgtgcaccaaggtccccgcgccccggaacgggcgacgccgcgcccccatcagagccgcgggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctcc

SEQ ID NO: 121731 - DNA, 849 bp, Homo sapiens
  Payload ID: 3865
  Gene Symbol: COMMD5
  Gene Name: COMM domain containing 5
  ENST ID: ENST00000529143
  CDS Start-End: 336-849
cccggatggctctttggagtgggaaggagctcctggtgctggcgggacggtgaaggagttggcagtgggtggtcgttgactcccagggagaatggggcgccgtgaagcccgtggggagctcctgggctcccccagcgctgtgcagagtggcctgacaagtgcctcgaggacaggagctgtgccccgctgagctctgctccagtacctggtgtgctgaggtgggcacgtgcgtttcctctggcatagcaggtgcttgtgctgctgcactgctccttcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccc

SEQ ID NO: 121732 - DNA, 1329 bp, Homo sapiens
  Payload ID: 3865
  Gene Symbol: COMMD5
  Gene Name: COMM domain containing 5
  ENST ID: ENST00000530332
  CDS Start-End: 1-511
ggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcaagcgatatctgaagtggctctgatgcctttgccacactcctcgcatctctgggacatcccttccgcactctctccctgactttcaagaggctgacaatccaggccgctgcttcccagctccttacatccctggggtgcgtccttggtgaaggtcttgggaaccacagtctcctcattcaaacagttattttggaaggtaaagcctgtcactttcagcccgggactgcccagatgactgtctaaccagacctcagaatcagaaacgtctccaaagccaggattctgaggaaagtcctgtggggagattctgaccactgtcccataggattctgattttaggatgtccatgtcctcacaggcctgctcattttcagtcctaatcgtagaatctgaaataaacaggaacaaagacgttccttaggccctgtgctcagagaaatgataagactacaaatgcgggggccagggctcaaggctcccaggatagttgcactgagcactgtgaggccccaggtggaaacgtgcaagagaaggcagagcctttgacagttctcaaaagtggtttcatactttttaccttgttcactcattcgatagcaatgaatgttcattgctggggcagggctgggttctgtgagcagagaggtccatcctacaggcactggtgtggggcacagtccatgcagaggcaaaggagacaaa

SEQ ID NO: 121733 - DNA, 1571 bp, Homo sapiens
  Payload ID: 3865
  Gene Symbol: COMMD5
  Gene Name: COMM domain containing 5
  Uniprot ID: Q9GZQ3
  ENST ID: ENST00000543949
  CDS Start-End: 400-1074
cggaagtggctctcagggcgcttccggggaccaggcccgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggtaggttggccccgaaccgtgggggcggcgacggccgagtgccaatttgactctgtgcaccaaggtccccgcgccccggaacgggcgacgccgcgcccccatcagagccgcgggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaatagctcatc

SEQ ID NO: 121734 - DNA, 486 bp, Homo sapiens
  Payload ID: 3866
  Gene Symbol: COMMD6
  Gene Name: COMM domain containing 6
  Uniprot ID: Q7Z4G1
  ENST ID: ENST00000355801
  CDS Start-End: 37-333
ctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagcctcagctcctggcaacctccagtctcctttctgcttctaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 121735 - DNA, 580 bp, Homo sapiens
  Payload ID: 3866
  Gene Symbol: COMMD6
  Gene Name: COMM domain containing 6
  ENST ID: ENST00000377612
  CDS Start-End: 166-285
tgatcaccaaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtgagttccaacctggaaggagaattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 121736 - DNA, 1793 bp, Homo sapiens
  Payload ID: 3866
  Gene Symbol: COMMD6
  Gene Name: COMM domain containing 6
  Uniprot ID: Q7Z4G1
  ENST ID: ENST00000377615
  CDS Start-End: 166-423
tgatcaccaaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacagtagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaatttaaaccctcttcacaccctgtctgcatttctgcaggtctgtgtgagtccactttcttttttgttccctgctaggtagcacacagctgtgaggagcccaggactgctgcctgccgcagcccacctgtgcgctcagattcctaccagcttgatgagttagctgatgggccatttgtgcataccaactacccacagacatttctattacccaccctctggatgccagtgcattaatgattctagaattaggagaaaccaaagatcccttctctctccctcccacaaccagtgtcgtcgtgttcctagaaataagagtagaaacccctctatctgggttaaaacagcaaacctgccttctgtaactgtgcatgaggttcctctgtctcccacttacttcggattaacaccttcctctttccccttccctgtttgcagggtagcatttctaggtttaaggcaatatgcaaaaagacccaaagttaggccctggctcaaacactgtgggtagcagatttgaaataaatttaaattgca

SEQ ID NO: 121737 - DNA, 594 bp, Homo sapiens
  Payload ID: 3866
  Gene Symbol: COMMD6
  Gene Name: COMM domain containing 6
  ENST ID: ENST00000377619
  CDS Start-End: 139-441
cacggccgcgaggccgtgccaccctgagccttccccaggtctcccctagtcctgtgtccgcgagccggtgaccttcagccgtccctcttgcattgctccttctcttttgcacctgagccggtagccgttgccattgtaatgaaagctcctcttccccaccctgcactagcccgaagaatgcagatcaaggattgttgggctttgattaggcgacagttattcgaagccaggaacacgcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 121738 - DNA, 1628 bp, Homo sapiens
  Payload ID: 3866
  Gene Symbol: COMMD6
  Gene Name: COMM domain containing 6
  Uniprot ID: Q7Z4G1
  ENST ID: ENST00000406936
  CDS Start-End: 1-258
atggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacagtagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaatttaaaccctcttcacaccctgtctgcatttctgcaggtctgtgtgagtccactttcttttttgttccctgctaggtagcacacagctgtgaggagcccaggactgctgcctgccgcagcccacctgtgcgctcagattcctaccagcttgatgagttagctgatgggccatttgtgcataccaactacccacagacatttctattacccaccctctggatgccagtgcattaatgattctagaattaggagaaaccaaagatcccttctctctccctcccacaaccagtgtcgtcgtgttcctagaaataagagtagaaacccctctatctgggttaaaacagcaaacctgccttctgtaactgtgcatgaggttcctctgtctcccacttacttcggattaacaccttcctctttccccttccctgtttgcagggtagcatttctaggtttaaggcaatatgcaaaaagacccaaagttaggccctggctcaaacactgtgggtagcagatttgaaataaatttaaattgca

SEQ ID NO: 121739 - DNA, 120 bp, Homo sapiens
  Payload ID: 3866
  Gene Symbol: COMMD6
  Gene Name: COMM domain containing 6
  ENST ID: ENST00000626103
  CDS Start-End: 1-120
atggaggcgtccagcgagccgccgctggatgctaagtccgatgtgagttccaacctggaaggagaattttcagtggaaactgggtatggctgtgagctcagacacttgcagatctcttaa

SEQ ID NO: 121740 - DNA, 1900 bp, Homo sapiens
  Payload ID: 3867
  Gene Symbol: COMMD7
  Gene Name: COMM domain containing 7
  Uniprot ID: Q86VX2
  ENST ID: ENST00000278980
  CDS Start-End: 607-1209
gtgatgctggggtgatgctgatgcccttccaaggttgagacctagtctctactctgatgtcagctctccgagagacactctggcctgctttgttcccttccctgtccccagtgtctggcatcgagtaggctgccataaatatctctggagtgcatagtaacagtgatgatgataatagcagctagccattgattgaagacctcttgtgtgccggtctctgcgttaaacatttctggaggcttaactcatttaaggagctaccccagccatcattttctcagatggtgaaactgaggttcagagaggccaagcgccgtacccaaaggtcactcagcgggagagctggcaggaaacctcgcgtctgccggtgccggcgccgcccctgcccctccccggagcccggcggccgcgcgtgtccgcggccctgcgagggctccccggctccggacagcccagggcggccgggggaggagtgcgctgcgacggccgtggcgaaagtgcggttgtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaaaggtctgga

SEQ ID NO: 121741 - DNA, 1343 bp, Homo sapiens
  Payload ID: 3867
  Gene Symbol: COMMD7
  Gene Name: COMM domain containing 7
  Uniprot ID: Q86VX2
  ENST ID: ENST00000446419
  CDS Start-End: 65-664
agcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaag

SEQ ID NO: 121742 - DNA, 488 bp, Homo sapiens
  Payload ID: 3867
  Gene Symbol: COMMD7
  Gene Name: COMM domain containing 7
  ENST ID: ENST00000474815
  CDS Start-End: 16-488
gctggggcgcgcgccatgggccgcctgcactgcactgaggacccggtgccggaggccgtgggcggcgacatgcagcagctgaaccagctgggcgcgcagcagttctcagccctgacagaggtgcttttccacttcctaactgagccaaaagaggcccgggttttcactgttctctctctgcaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcag

SEQ ID NO: 121743 - DNA, 1987 bp, Homo sapiens
  Payload ID: 3867
  Gene Symbol: COMMD7
  Gene Name: COMM domain containing 7
  ENST ID: ENST00000610160
  CDS Start-End: 55-228
gaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcaggctgcaggtgccaaccaaggcagtcttggaggcatcctgcttctgtgctggttgggatgccttttcataccaccaaggctgctgaaatagttctcagccctgacagaggtgcttttccacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatataggtgagtctgaattcccacttgagcctcttcaccttttttgtgttctctgcaatcaggggctggtgacgctcaccacaaatcatgtcttctataaaaacagtcattgccagctgtggagtagctgttccactgcctttcctctcctgaaagatggcacaaggagtgttagaaagccactggcaggttggagcccccacagttgaagagccgttttgaaaaagggaaagggtgggaacggaatggctgggattgaagaagaaggttgacgagcaagaagctcttgccatagaagtcacattgaacatcccgaatgataccctttcatctctttgtgccatggagctgtgccatttgaacactcactccccttttttttcctttggagcagagaaccttctgcattcaagtctctcagttctttattatgatcagttacccatcaagagctgcttagatgtattaagccaaaaaagaaaaaaaaaatcctccgggtggaaattaattttcttggatgattctgtggagttggaaacatttatctgaagctgaattttctctccccagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaag

SEQ ID NO: 121744 - DNA, 1469 bp, Homo sapiens
  Payload ID: 3868
  Gene Symbol: COMMD8
  Gene Name: COMM domain containing 8
  Uniprot ID: Q9NX08
  ENST ID: ENST00000381571
  CDS Start-End: 69-620
gggcgagtcgtagctttagacaagcggccagccttgacacgtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagatattgccaaatttttcaaagccatagttggtaaaaacttacctgatgaagagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaagcttgcactttccagtgacaagattgctgcattacgaatgccacttttaagcctgcatctagatgtaaaagaaaatggtgaagtaaaaccttattctattgaaatgagtagagaggagctgcagaatctaatacagtccttggaagcagcgaataaggtggtcctgcagttgaaataactggaaatgatgaataccagtcctatcagattttattgctccaacttatatggcagagtgaatactgcgtgttcagaaaccttgtgatgtcttgactgttgcaccaggctgagaaagcagcaatattgatattataaagataaaaatttatcaacattccttaacaggaaattacatggttgagaggaaatgcataaaatgaaagatgaaaaatctatagtagcagtttatattttcatgattgttttgcctcatttattaaatatttgagaaatctttggagatacatagttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaatactttgggatgttaaattcattggaaaaacaaaccatttgtaacctcagttaactttaacaacaagcattctgagc

SEQ ID NO: 121745 - DNA, 2954 bp, Homo sapiens
  Payload ID: 3869
  Gene Symbol: COMMD9
  Gene Name: COMM domain containing 9
  Uniprot ID: Q9P000
  ENST ID: ENST00000263401
  CDS Start-End: 18-614
catgtgacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaactaaacaacagttctaaaacttccatgatttttgtagcttcttttgtccccaagttgaagcttttggccagtaccttctctagtttttaaagatgatcccaacttcctaattcccagctaagcccttgacccatggtgtgacatgaaatcaggcaattgaatcgcaccactttctgtgttttcacctgttacgtagaacaaaaggaagcaaggtggccaggcgcaatggctcacgcctgtaatcccagcactttgggaggccgaggcaggcagatcatgaggtcaggagatcgagaccatggtgaaaccccatctctactaaaaatacaaaaaattagctgggcgcggtggcgggcatctgtagtcccagctcctcgggaggctgaggcaggagaatggcgtgaacctgggaggcagagcttgcagtgagccgagatcgtgccactgcactccagtctgggtgacagagaaggactcgtctcaaaaaataaaaataaataaaaaggaagcaaggctaatcatcagtatgtgcttgttacaagagctatgatgaaggcactccttcgagtttaaccaaatgagatcatctctgtcatgtgcctcacgcctcacagggactccatgtgtgaagattcccccttcactcaccagatcatctccatggcaacagcttgcagcctgctcttggagtgctttgttttggcagcttctctgctagtttgtgtatggagtgaatggaggaggtaaatccacagattaagaatatgctgtcaggagtcaggcagccaaggtcagaagccagctctgcttctcagtggtaaggtgcttgacttctacatctcaattttcacccactttgtacttttttcctaaattaaatgagtataatagtagtacctacttgataggacttttgtgaaaattaaatgatataatgcacctaaaaacagtactgttacaactaataggaaaggctttgattattaatggatgagagtagaaagcttggtgcatttattgtctcatctactataacagagttggtgtgagaattagtattatcatcctccctttattgaccaggaaaccagctcattgagattgagtcatctgctggtaaatggtctcattaagaggtggacccatatttctctagctttctctttacaacacaggactttgcaaggaacatataattctgtgactagcgccatttggaaaatgttgaaactgaagtagagatgagagatcttacgtctgcctacccagtgagatacgaggaaggtcaagggaaaaaaaattccaagctcttctttatctgctataggaaatgaacattcaattttttgcatgcaacgacaagaggtcaaggaccccagaagccagcccgctacttccaagttgagagcccctggtcataccctccagttgagctcagatttgtcacaaatttacccctctcctttccttccattccccatgacctgcagagagagatgtcagataccttcctcttggcctcccatgggcatccataagaaacttacttgaagcaagaagcccagtataggtgtctgggcagttggacatttcctctagccagatctgtccgaatagagccatctgggtacatgacgcagagggcatttgataaataactggaaaagtcaataaatctttgctacccttca

SEQ ID NO: 121746 - DNA, 917 bp, Homo sapiens
  Payload ID: 3869
  Gene Symbol: COMMD9
  Gene Name: COMM domain containing 9
  Uniprot ID: Q9P000
  ENST ID: ENST00000452374
  CDS Start-End: 38-508
gcttccctgggtgccacggtcatgtgacttcggcaagatggctgccctgacagcggagcattttgcagcactccagagcctgctcaagctgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaa

SEQ ID NO: 121747 - DNA, 881 bp, Homo sapiens
  Payload ID: 3869
  Gene Symbol: COMMD9
  Gene Name: COMM domain containing 9
  ENST ID: ENST00000532705
  CDS Start-End: 13-570
gacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgttctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctc

SEQ ID NO: 121748 - DNA, 745 bp, Homo sapiens
  Payload ID: 3870
  Gene Symbol: COMMD3-BMI1
  Gene Name: COMMD3-BMI1 readthrough
  ENST ID: ENST00000417470
  CDS Start-End: 1-161
agatgctggcggatccccgctccttcgactccaacgccttcacgcttctcctccgggcggcattccagagtctgctggacgcccaggcggacgaggccgtgttaggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatg

SEQ ID NO: 121749 - DNA, 508 bp, Homo sapiens
  Payload ID: 3870
  Gene Symbol: COMMD3-BMI1
  Gene Name: COMMD3-BMI1 readthrough
  ENST ID: ENST00000475460
  CDS Start-End: 31-508
gtgcgtgtcgaaggtcacggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaaggattttttatcaagcagaaatgcatcgaacaacgagaatcaagatcactgagctaaatccccacctgatgtgtgtgctttgtggagggtacttcattgatgccacaaccataatagaatgtctacatt

SEQ ID NO: 121750 - DNA, 1419 bp, Homo sapiens
  Payload ID: 3870
  Gene Symbol: COMMD3-BMI1
  Gene Name: COMMD3-BMI1 readthrough
  ENST ID: ENST00000602390
  CDS Start-End: 10-1419
gcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaacactgattccccatcctatccagagattagttttagttgcagcatggaacaattacaggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttga

SEQ ID NO: 121751 - DNA, 329 bp, Homo sapiens
  Payload ID: 3870
  Gene Symbol: COMMD3-BMI1
  Gene Name: COMMD3-BMI1 readthrough
  ENST ID: ENST00000489125
  CDS Start-End: 1-329
agtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaaggattttttatcaagcagaaatgcatcgaacaacgagaatcaagatcactgagctaaatccccacctgatgtgtgtgctttgtggagggtac

SEQ ID NO: 121752 - DNA, 7470 bp, Homo sapiens
  Payload ID: 3871
  Gene Symbol: CR1
  Gene Name: complement component (3b/4b) receptor 1 (Knops blood group)
  ENST ID: ENST00000367049
  CDS Start-End: 1-7470
atgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttga

SEQ ID NO: 121753 - DNA, 7469 bp, Homo sapiens
  Payload ID: 3871
  Gene Symbol: CR1
  Gene Name: complement component (3b/4b) receptor 1 (Knops blood group)
  Uniprot ID: P17927
  ENST ID: ENST00000367051
  CDS Start-End: 112-6231
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataa

SEQ ID NO: 121754 - DNA, 7469 bp, Homo sapiens
  Payload ID: 3871
  Gene Symbol: CR1
  Gene Name: complement component (3b/4b) receptor 1 (Knops blood group)
  ENST ID: ENST00000367052
  CDS Start-End: 112-6231
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataa

SEQ ID NO: 121755 - DNA, 7469 bp, Homo sapiens
  Payload ID: 3871
  Gene Symbol: CR1
  Gene Name: complement component (3b/4b) receptor 1 (Knops blood group)
  Uniprot ID: P17927
  ENST ID: ENST00000367053
  CDS Start-End: 112-6231
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataa

SEQ ID NO: 121756 - DNA, 6959 bp, Homo sapiens
  Payload ID: 3871
  Gene Symbol: CR1
  Gene Name: complement component (3b/4b) receptor 1 (Knops blood group)
  Uniprot ID: P17927
  ENST ID: ENST00000400960
  CDS Start-End: 41-6160
cttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcct

SEQ ID NO: 121757 - DNA, 1981 bp, Homo sapiens
  Payload ID: 3871
  Gene Symbol: CR1
  Gene Name: complement component (3b/4b) receptor 1 (Knops blood group)
  ENST ID: ENST00000529814
  CDS Start-End: 1-1981
gatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcaggtacct

SEQ ID NO: 121758 - DNA, 3740 bp, Homo sapiens
  Payload ID: 3871
  Gene Symbol: CR1
  Gene Name: complement component (3b/4b) receptor 1 (Knops blood group)
  ENST ID: ENST00000534202
  CDS Start-End: 8-1822
ggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattaga

SEQ ID NO: 121759 - DNA, 1788 bp, Homo sapiens
  Payload ID: 3872
  Gene Symbol: CR1L
  Gene Name: complement component (3b/4b) receptor 1-like
  Uniprot ID: Q2VPA4
  ENST ID: ENST00000508064
  CDS Start-End: 61-1770
ggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagcccctcagtgcattatacctaacaaatgcacgcctccaaatgtggaaaatggaatattggtatctgacaacagaagcttattttccttaaatgaagttgtggagtttaggtgtcagcctggctttggcatgaaagggccctcccatgtgaagtgccaggccctgaacaaatgggagccagagttaccaagctgctccagggtatgtcagccacctccagatgtcctgcatgctgagcgtacccaaagggacaaggacaacttttcacccgggcaggaagtgttctacagctgtgagcccggctacgacctcagaggatctacgtatttgcactgcacaccccagggagactggagccctgcagcccccagatgtgaagtgaaatcctgtgatgacttcctgggccaacttcctaatggccatgtgctatttccacttaatctccagcttggagcaaaagtggattttgtttgtgatgaaggatttcaattaaaaggcagctctgctagttactgtgttttggctggaatggaaagcctttggaatagcagtgttccagtgtgtgaacgtaaatcatgtgaaactcctccagttccagtgaatggcatggtgcatgtgatcacagacatccatgttggatccagaatcaactattcttgtactacagggcaccgactcattggtcactcatctgctgaatgtatcctctcgggcaatactgcccattggagcatgaagccaccaatttgtcaacaaatcttttgtccaaatcctccagctatccttaatgggagacacacaggaactccccttggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaacagtaagtacctacttat

SEQ ID NO: 121760 - DNA, 1587 bp, Homo sapiens
  Payload ID: 3872
  Gene Symbol: CR1L
  Gene Name: complement component (3b/4b) receptor 1-like
  ENST ID: ENST00000294997
  CDS Start-End: 1-1167
attgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagcccctcagtgcattatacctaacaaatgcacgcctccaaatgtggaaaatggaatattggtatctgacaacagaagcttattttccttaaatgaagttgtggagtttaggtgtcagcctggctttggcatgaaagggccctcccatgtgaagtgccaggccctgaacaaatgggagccagagttaccaagctgctccagggtatgtcagccacctccagatgtcctgcatgctgagcgtacccaaagggacaaggacaacttttcacccgggcaggaagtgttctacagctgtgagcccggctacgacctcagaggatctacgtatttgcactgcacaccccagggagactggagccctgcagcccccagatgtgaagtgaaatcctgtgatgacttcctgggccaacttcctaatggccatgtgctatttccacttaatctccagcttggagcaaaagtggattttgtttgtgatgaaggatttcaattaaaaggcagctctgctagttactgtgttttggctggaatggaaagcctttggaatagcagtgttccagtgtgtgaacgtaaatcatgtgaaactcctccagttccagtgaatggcatggtgcatgtgatcacagacatccatgttggatccagaatcaactattcttgtactacagggttctgattaaaaggcaggtctgctagtcattgtgtcttggctggaatgaaagccctttggaatagcagtgttccagtgtgtgaacaaatcttttgtccaaatcctccagctatccttaatgggagacacacaggaactccccttggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggttcacatgatgctcttatagttggcactttacttggtacgatcatctttattttaatcatcattttcctctattggataattttcaagcacagaaaaagggaccttccttga

SEQ ID NO: 121761 - DNA, 4240 bp, Homo sapiens
  Payload ID: 3873
  Gene Symbol: CR2
  Gene Name: complement component (3d/Epstein Barr virus) receptor 2
  Uniprot ID: P20023
  ENST ID: ENST00000367057
  CDS Start-End: 190-3468
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaaggctgccagtcacctcctgggctccaccatggtcgtcatacaggtggaaatacggtcttctttgtctctgggatgactgtagactacacttgtgaccctggctatttgcttgtgggaaacaaatccattcactgtatgccttcaggaaattggagtccttctgccccacggtgtgaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 121762 - DNA, 4063 bp, Homo sapiens
  Payload ID: 3873
  Gene Symbol: CR2
  Gene Name: complement component (3d/Epstein Barr virus) receptor 2
  Uniprot ID: P20023
  ENST ID: ENST00000367058
  CDS Start-End: 190-3291
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 121763 - DNA, 3877 bp, Homo sapiens
  Payload ID: 3873
  Gene Symbol: CR2
  Gene Name: complement component (3d/Epstein Barr virus) receptor 2
  ENST ID: ENST00000367059
  CDS Start-End: 190-3105
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 121764 - DNA, 1169 bp, Homo sapiens
  Payload ID: 3874
  Gene Symbol: C1QBP
  Gene Name: complement component 1, q subcomponent binding protein
  Uniprot ID: Q07021
  ENST ID: ENST00000225698
  CDS Start-End: 83-931
gcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 121765 - DNA, 383 bp, Homo sapiens
  Payload ID: 3874
  Gene Symbol: C1QBP
  Gene Name: complement component 1, q subcomponent binding protein
  ENST ID: ENST00000576122
  CDS Start-End: 357-383
ccgacctctgaggtctgggacatttttccattgattggcaaccagcgggctaaacccacgtatgatcatatttcccccacctcccctatccagcagtttcgttttcttttggtagggggtgaataaaattaaatactagggtacctttttccttagtcttattctatcgaaagtggacctttgggaaggcccatggtcgtggttgaaaatagcatagttatatcgtttggcaagtggaagaggattggaaattctcctggtttatagcggaaagtggagacaaagcttttgttgatttcctgagtgatgaaattaaggaggaaagaaaaattcagaagcataaaaccctccctaagatgtctggaggttgggagctggaactg

SEQ ID NO: 121766 - DNA, 901 bp, Homo sapiens
  Payload ID: 3874
  Gene Symbol: C1QBP
  Gene Name: complement component 1, q subcomponent binding protein
  ENST ID: ENST00000574444
  CDS Start-End: 151-687
agggcctgcaaccgacctctgaggtctgggacatttttccattgattggcaaccagcgggctaaacccacgagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagac

SEQ ID NO: 121767 - DNA, 688 bp, Homo sapiens
  Payload ID: 3874
  Gene Symbol: C1QBP
  Gene Name: complement component 1, q subcomponent binding protein
  ENST ID: ENST00000570805
  CDS Start-End: 156-688
gctgagggacatctgcttaaaggtatcgtctggtcctagtgttctgtgggtgacaaagctgtcactttgttcaaggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagcca

SEQ ID NO: 121768 - DNA, 1143 bp, Homo sapiens
  Payload ID: 3875
  Gene Symbol: C1QA
  Gene Name: complement component 1, q subcomponent, A chain
  Uniprot ID: P02745
  ENST ID: ENST00000374642
  CDS Start-End: 205-942
agtcttgctgaagtctgcttgaaatgtccctggtgagcttctggccactggggaagttcagggggcaggtctgaagaaggggaagtaggaagggatgtgaaacttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 121769 - DNA, 976 bp, Homo sapiens
  Payload ID: 3875
  Gene Symbol: C1QA
  Gene Name: complement component 1, q subcomponent, A chain
  Uniprot ID: P02745
  ENST ID: ENST00000402322
  CDS Start-End: 38-775
acctgcccaggccctcccgtgtctccacagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 121770 - DNA, 768 bp, Homo sapiens
  Payload ID: 3875
  Gene Symbol: C1QA
  Gene Name: complement component 1, q subcomponent, A chain
  ENST ID: ENST00000438241
  CDS Start-End: 107-768
ccaggaggctgggcagctgaggcagggagggagggaaataactgtgcctgattctaggacagggatgggggtgcagcactgatccaggacccagaatggaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccc

SEQ ID NO: 121771 - DNA, 1044 bp, Homo sapiens
  Payload ID: 3876
  Gene Symbol: C1QB
  Gene Name: complement component 1, q subcomponent, B chain
  Uniprot ID: P02746
  ENST ID: ENST00000314933
  CDS Start-End: 133-894
gcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaaggga

SEQ ID NO: 121772 - DNA, 977 bp, Homo sapiens
  Payload ID: 3876
  Gene Symbol: C1QB
  Gene Name: complement component 1, q subcomponent, B chain
  ENST ID: ENST00000432749
  CDS Start-End: 292-977
gcccttcccgcctctggggaagggaacttccgcttcggaccgagggcagtaggctctcggctcctggtcccactgctgctcagcccagtggcctcacaggacaccagcttcccagccctgtcaggttgaaatcagcattgccaagaggctcagagaggttaaggcacttgcctgaggttatgcagccggtagcagatggggctttaaagtcaagtgggcctgactccatgttgcggaaagggactgctggaccgaaggagatggaaaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactc

SEQ ID NO: 121773 - DNA, 1254 bp, Homo sapiens
  Payload ID: 3876
  Gene Symbol: C1QB
  Gene Name: complement component 1, q subcomponent, B chain
  ENST ID: ENST00000509305
  CDS Start-End: 347-1102
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaagggaca

SEQ ID NO: 121774 - DNA, 677 bp, Homo sapiens
  Payload ID: 3876
  Gene Symbol: C1QB
  Gene Name: complement component 1, q subcomponent, B chain
  ENST ID: ENST00000510260
  CDS Start-End: 218-677
agcaggtacaattatggtcccatcctatagcagagaaaattggggctcccttgactgacaacacatcaactggcaagtggcagaggcgggattggaatcaaaggctctgactgtaagccagcactcaggcagcgggcccgccacatgatgctcactgaggaacacccctgcccagtgtagaagaagatcacgaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagcccc

SEQ ID NO: 121775 - DNA, 1089 bp, Homo sapiens
  Payload ID: 3877
  Gene Symbol: C1QC
  Gene Name: complement component 1, q subcomponent, C chain
  Uniprot ID: P02747
  ENST ID: ENST00000374637
  CDS Start-End: 248-985
tgggagaggggaagcagatctgaggacatctctgtgccaggccagaaaccgcccacctgcaggtgaggcccggacccctgcccaggtatgggcagatggccgtttcctccaccttccgccaccttcctgaaatgtggtgccaggggcagcttggtgtgtgaggggaaggagggttcccactcctgctgggccccggggcctgggctgaagaaaaggccccaccatccatccatgttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccc

SEQ ID NO: 121776 - DNA, 1183 bp, Homo sapiens
  Payload ID: 3877
  Gene Symbol: C1QC
  Gene Name: complement component 1, q subcomponent, C chain
  Uniprot ID: P02747
  ENST ID: ENST00000374639
  CDS Start-End: 119-856
agacaccgtgtcctcttgcctgggagaggggaagcagatctgaggacatctctgtgccaggccagaaaccgcccacctgcaggtgaggcccggacccctgcccagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacata

SEQ ID NO: 121777 - DNA, 1163 bp, Homo sapiens
  Payload ID: 3877
  Gene Symbol: C1QC
  Gene Name: complement component 1, q subcomponent, C chain
  Uniprot ID: P02747
  ENST ID: ENST00000374640
  CDS Start-End: 99-836
ctcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacata

SEQ ID NO: 121778 - DNA, 1295 bp, Homo sapiens
  Payload ID: 3878
  Gene Symbol: C1QL1
  Gene Name: complement component 1, q subcomponent-like 1
  Uniprot ID: O75973
  ENST ID: ENST00000253407
  CDS Start-End: 24-800
tagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctccgctccctccggggtggcgcgcccgggggaggggggagttgggggctggatagcttcccagcaccctcagagcccccgcccggctgtgccccgtctgaccaaagttataataaaaacattttcaccccgca

SEQ ID NO: 121779 - DNA, 2043 bp, Homo sapiens
  Payload ID: 3879
  Gene Symbol: C1QL2
  Gene Name: complement component 1, q subcomponent-like 2
  Uniprot ID: Q7Z5L3
  ENST ID: ENST00000272520
  CDS Start-End: 621-1484
gacatgagggctccgtctcccgagtgatggcagcgcgcgctgcttcgccgcctccgccgctcagccccggactccttacgtcagggtagcggggtcccccctccgcgcgggagccagcgaacagcgagagagcacagcagagcgcgccgcggagccggggcgccctcactgcgctaggagccccactaaacccagcggagcggagcctggcgggaggcagcgccgcggagccagcgccggacgccgcaagcagactccccggccagcgcaagcactccctggccggcgccggaccctcggggcgccggattcgtcttgtgtgccccacgtcatgcgcgcgggcgtccgcggctctcccgaccagccccagcgcggtgggcccaggctcagaggtcccggcgcctctcgctgaagtagttgggtagccggggctgggggtcgccacgtcgggggcgcggccaggacccgcggagccggtccccgagcgcggggagcggggccgcccgcgccgccccaccattacctccccgggcggcaaggaggagctggtggcggtcgcctcccggctgtggcagcggcggcggcgtgcctgcctggcggccgtcggcgtactcttggccatggcgctcgggctgctcatcgccgtgccgctgctgctgcaggcggcgccccgaggcgccgcgcactatgagatgatgggcacctgccgcatgatctgcgacccttacactgccgcgcccggcggggagcccccgggtgcaaaggcgcagccacccggacccagcaccgccgccctggaagtcatgcaggacctcagcgccaaccctcctcctcctttcatccagggacccaagggcgacccggggcgaccgggcaagccagggccgcgggggccccctggagagccgggcccgcctggacccaggggccctccgggagagaagggcgactcggggcggcccgggctgccagggctgcaactgacggcgggcacggccagcggcgtcggggtggtgggcggcggggccggggtaggtggcgattccgagggtgaagtgaccagtgcgctgagcgccaccttcagcggccccaagatcgccttctatgtgggtctcaagagcccccacgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcgcggggggtgcgaggcggggtggctgcaggccgcccggtctccgcccgggcgcggctccttggcaaaggccactctcgattcataacacttcctgacatctcctttggaaaagacaaatccctgcgtcctccctgccccgctcctggcctcagtgcgtctgcgacccaccacgctcagggctgtgctcctggtctccatccccatcccggcaagggaggaagggacgcccgagcccttgaggcggcggcacagactttgcaaacctgattagactggacaggcagggccgggagcctgccctcctcagacagcctcctcccagtgcctagaagcggagggctccgggccctggccagggaggtaggccagagggagcgcgggcttcctggggcgtccttctttgtgacccgaaatacttgtgcagatttccctgtccatcagccaaaaccccacccacagcagaattccagcaaacagaaaattcacctctccacaccgcattccctcctgactcagactcaccgcgatgcattaaattatgtttttagactatg

SEQ ID NO: 121780 - DNA, 2493 bp, Homo sapiens
  Payload ID: 3880
  Gene Symbol: C1QL3
  Gene Name: complement component 1, q subcomponent-like 3
  Uniprot ID: Q5VWW1
  ENST ID: ENST00000298943
  CDS Start-End: 941-1708
tcagagtaatgccaaactctctctgagtgggatgagcagagcagatgctgcaatgagatgccaaagcggctccccttcctctgtgccttgggtgcctataaattgctccggcgcgcgtttgtcagcctcctcttctcctggcaggtggtacccaggcagaattctgccttcagtctctctctcgctccgctcccggccgtgaggcgctcgccgctgctcgctcgctcctccgccccagctctgagcctcgccgtgccgaccgtgcccgccgccgccgccgctgggcgcacccgggggacgcccgggcccacgcggggctttggggtgcgcgtctattcgagttgtggtggtggcaaaggaggaagagagaaaggaggcaataaaaaaaaaaggcagcggacgggcgaactgagcgagcgaaagaagaggaggaggaggcagaaaaaggcaacttcagacggaaagttggtgcgaacaggcgcagtctgcaaaaacggaaaagtcgatcgcaggcggcggcggcataaaagtgtgagctgcccgggcgagctcaggaggcggcggctggctctgccctcccggtggccgcgccggcgccggctgcagccacaggtgcgaaggagctcgcggggggcgagggcgccccgcgcacccctcccccggcccccaccccgggctcgggacttcggctcaagtcactgggcgcccgcgctccctccccagccgcagcctccgcggggggagcaggagtcggcagcagcggccggcgcacgcacgcccaggggagttggggttcgcagggggttgttttcggctctgaagaggtccccgcccaaccttcaaaattctgtccaaaagcagacaagaggatcgccccgcgctgagccggctggtgggcagcaggaggcgcctgatcgccgccggggcgctgggggtggtgatggtgctgctgctggtgatcctcatcccggtgctggtgagctcggccggcacgtcggcgcactacgagatgctgggcacctgccgcatggtctgcgacccctacgggggcaccaaggcgcccagcaccgctgccacgcccgaccgcggcctcatgcagtccctgcccaccttcatccagggccccaaaggcgaggccggcaggcccgggaaggcgggtccgcgcgggccccccggagagcccgggccacccggccccatggggcccccgggcgagaagggcgagccgggccgccaaggcctgccgggcccgcccggggcgcccggcctgaacgcggccggggccatcagcgccgccacctacagcacggtgcccaagatcgccttctacgccggcctcaagcggcagcatgaaggctacgaggtgctcaagttcgacgacgtggtcaccaacctcggaaaccactacgaccccaccaccggcaagttcacctgctccatcccgggcatctacttcttcacctaccacgtcctgatgcgcggaggggacggcaccagcatgtgggctgatctctgcaaaaacaaccaggtgcgtgctagtgcaattgcccaagatgctgatcagaattacgactatgccagtaacagtgtggttcttcatttggagccgggagatgaagtctatatcaaattagatggcgggaaagcccatggaggaaacaacaacaaatacagcacgttttctggatttattatttatgctgactgataatgcagaaactaagcttattattctgagtttgaacactggattcgtatggctaacgtcagtgaatcaaggatcccaggggatgccaatggcagggcacctcagttgtgtatatgtggggaaatcaaatgctacctgactcacatctgtatcactcagaaacattatgtaaaaaatatcaaagcaagataagcagatgtgtgatccactaccgccaaagcaaatactccttatcgttagtgtccatgtgaatgaagtcctatatagatcacaaatttttatagacaaatctaagacattgaattatttcttctatatatatgatactttggtgtactgtgatcttgctgcttttatccatatgtcagctttggttcttgtgagtttacctgcttattatgatacttggagtccattcatagtgtggggaagaatgatttttgccctgcaggagaaggtctaattgaaataatgctgcttgtccccaaagaaattgtttgccttgtactcttgttaaccttagagctagacctgggaatgattcaacttcaagccttaacctggaattttctggatttgagggaattcccaagcctatgatctttttcacattttctttttcttatatgaattttcttttctctcttttctggtgatagtctttaaaaatagagattgacagtgtatcataggattaccctctaagtgtgaaaatgtgtaattatgtacggtatttagaaaaagcccttatgtgtccattttgtcaactgaatacatttagattc

SEQ ID NO: 121781 - DNA, 783 bp, Homo sapiens
  Payload ID: 3880
  Gene Symbol: C1QL3
  Gene Name: complement component 1, q subcomponent-like 3
  Uniprot ID: Q5VWW1
  ENST ID: ENST00000619991
  CDS Start-End: 81-722
gacaagaggatcgccccgcgctgagccggctggtgggcagcaggaggcgcctgatcgccgccggggcgctgggggtggtgatggtgctgctgctggtgatcctcatcccggtgctggtgagctcggccggcacgtcggcgcactacgagatgctgggcacctgccgcatggtctgcgacccctacgggggcaccaaggcgcccagcaccgctgccacgcccgaccgcggcctcatgcagtccctgcccaccttcatccagggcccgcccggggcgcccggcctgaacgcggccggggccatcagcgccgccacctacagcacggtgcccaagatcgccttctacgccggcctcaagcggcagcatgaaggctacgaggtgctcaagttcgacgacgtggtcaccaacctcggaaaccactacgaccccaccaccggcaagttcacctgctccatcccgggcatctacttcttcacctaccacgtcctgatgcgcggaggggacggcaccagcatgtgggctgatctctgcaaaaacaaccaggtgcgtgctagtgcaattgcccaagatgctgatcagaattacgactatgccagtaacagtgtggttcttcatttggagccgggagatgaagtctatatcaaattagatggcgggaaagcccatggaggaaacaacaacaaatacagcacgttttctggatttattatttatgctgactgataatgcagaaactaagcttattattctgagtttgaacactggattcgtatggctaacgtca

SEQ ID NO: 121782 - DNA, 2071 bp, Homo sapiens
  Payload ID: 3881
  Gene Symbol: C1QL4
  Gene Name: complement component 1, q subcomponent-like 4
  Uniprot ID: Q86Z23
  ENST ID: ENST00000334221
  CDS Start-End: 712-1428
ataccacccgcgcccgggagggaggggaggaaggttagggaggcggagagggaccgcgcccgcaggagagaggcgcgggccagggctctagcagggactggggccgcggcaggggtagcaaggtgagtcggtgcttgccaagaggcagagcgcaaaacctactaggagatcgcgcccggtgagcagcacccgcagctcagagcccgggacgtccggagcgcggggagcagtcccctctccatcagggagtggtctatctgggcagtctgggacccaggcaccgcgccatccctgagagagcagcagtctggagagcaggcatctcagatccctaagaaaccagccgtccgagaagccgcggatctcaggtgcccaggatcgttaggactgaacgggagggtactagaggaccactggctctggaccgtcgggagctgcccctgacgtaacccacgaggggcctccccttgacggacggcttggggagcggcaccgccgcggctggagcccgcagaggcagggtaaggggagcggggggcagccgtcgggggagtgcagacccaggcccaaggcgggtcaccgcctcctggcccgcggagagccccggccccggcagccattgcgcccaagagtgaggaagatttgctggccctggcagcgtcgcggctgagccgccgcaagagggtggcgggcgcggccgtcggagtggccatggtgctgctgctgctggtggccatcccgctgctggtgcacagctcccgcgggccagcgcactacgagatgctgggtcgctgccgcatggtgtgcgacccgcatgggccccgtggccctggtcccgacggcgcgcctgcttccgtgccccccttcccgccaggcgccaagggagaggtgggccggcgcgggaaagcaggcctgcgggggccccctggaccaccaggtccaagagggcccccaggagaacccggcaggccaggccccccgggccctcccggtccaggtccgggcggggtggcgcccgctgccggctacgtgcctcgcattgctttctacgcgggcctgcggcggccccacgagggttacgaggtgctgcgcttcgacgacgtggtgaccaacgtgggcaacgcctacgaggcagccagcggcaagtttacttgccccatgccaggcgtctacttcttcgcttaccacgtgctcatgcgcggcggcgacggcaccagcatgtgggccgacctcatgaagaacggacaggtccgggccagcgccattgctcaggacgcggaccagaactacgactacgccagcaacagcgtcattctgcacctggacgtgggcgacgaggtcttcatcaagctggacggcgggaaagtgcacggcggcaacaccaacaagtacagcaccttctccggcttcatcatctaccccgactgagccggccccgccccgtgcccccgctcgccccttctctcccgtcctcacccacctcctgcccgccccacccgaggcgccaccccaccctttgagagcctggcggtggggtggacccttccgttcccggaggcggcctaaatgggcgaactcttggtgctcaagggtataagtggccgggaagaggaggagacccggccagaggagcagagcgacttccggagggatcacccgcacccaagtgcgcgctggaccccataggggcagaggtcgtggctttctcttttgtacagagatggggagcagttttaatagcgggactcagaggcccagaaagccggagggaagcccccgcagcttgcgagggaaataacagaaacaggaggagcccatttaggcaagagaagacattaaaacagggtagtgcaggttctccgtcacaactttctctcgccaccctctcgtcccctcgtctccactttcaggctcaggctccagccttggcagccttcctgtgaactggaggaaccagtgaattctttcctggcatttaaaacgcattctgtacagtccccattcccccctatccggactaggccctggggctacagctgctgctgcctcttctaataaagtgaggttgggg

SEQ ID NO: 121783 - DNA, 2660 bp, Homo sapiens
  Payload ID: 3882
  Gene Symbol: C1R
  Gene Name: complement component 1, r subcomponent
  Uniprot ID: P00736
  ENST ID: ENST00000542285
  CDS Start-End: 220-2337
acaaacagggatttcaaaaccaaaactaaattaaagtggaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaa

SEQ ID NO: 121784 - DNA, 2211 bp, Homo sapiens
  Payload ID: 3882
  Gene Symbol: C1R
  Gene Name: complement component 1, r subcomponent
  ENST ID: ENST00000535233
  CDS Start-End: 85-2100
gctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgc

SEQ ID NO: 121785 - DNA, 519 bp, Homo sapiens
  Payload ID: 3882
  Gene Symbol: C1R
  Gene Name: complement component 1, r subcomponent
  ENST ID: ENST00000540610
  CDS Start-End: 239-519
gttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacac

SEQ ID NO: 121786 - DNA, 591 bp, Homo sapiens
  Payload ID: 3882
  Gene Symbol: C1R
  Gene Name: complement component 1, r subcomponent
  ENST ID: ENST00000541042
  CDS Start-End: 377-591
acagaaaaccctcccctccctgctgtgcatgacgcgggctccctctgcacacagtgcacgaagacgctgtcgggagagcccaggattcaacacgggccttgagaaatgaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccg

SEQ ID NO: 121787 - DNA, 575 bp, Homo sapiens
  Payload ID: 3882
  Gene Symbol: C1R
  Gene Name: complement component 1, r subcomponent
  ENST ID: ENST00000540242
  CDS Start-End: 106-575
acagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtgggggaggaggatccccagccccagtgccagcacctgtgtcacaacta

SEQ ID NO: 121788 - DNA, 553 bp, Homo sapiens
  Payload ID: 3882
  Gene Symbol: C1R
  Gene Name: complement component 1, r subcomponent
  ENST ID: ENST00000538050
  CDS Start-End: 407-553
acactgccctggagagtgacccgatgcagcagctgcacaggccatcctccccacccacgcacccctgctgagaacatgtctgtgaggttcagggtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggag

SEQ ID NO: 121789 - DNA, 2347 bp, Homo sapiens
  Payload ID: 3882
  Gene Symbol: C1R
  Gene Name: complement component 1, r subcomponent
  ENST ID: ENST00000536053
  CDS Start-End: 77-2236
gacactgccctggagagtgacccgatgcagcagctgcacaggccatcctccccacccacgcacccctgctgagaacatgtctgtgaggttcagggtgggcagagaggagaatgcccagtggtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgc

SEQ ID NO: 121790 - DNA, 521 bp, Homo sapiens
  Payload ID: 3882
  Gene Symbol: C1R
  Gene Name: complement component 1, r subcomponent
  ENST ID: ENST00000543835
  CDS Start-End: 54-521
agtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgag

SEQ ID NO: 121791 - DNA, 832 bp, Homo sapiens
  Payload ID: 3882
  Gene Symbol: C1R
  Gene Name: complement component 1, r subcomponent
  ENST ID: ENST00000543362
  CDS Start-End: 43-477
acgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtgggtctctggtgagtgacctccctaagatcagagccactactcaggtctcccagcagaagcttaaccctccttcctgaatgccttccagaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctca

SEQ ID NO: 121792 - DNA, 3394 bp, Homo sapiens
  Payload ID: 3883
  Gene Symbol: C1RL
  Gene Name: complement component 1, r subcomponent-like
  Uniprot ID: Q9NZP8
  ENST ID: ENST00000266542
  CDS Start-End: 94-1557
atttccaggaacttcctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattgaccctgggggcttgaacagggactgaccagcacagtggaggccccaggcaacagagggcctggagtgaggactgaacactggggtaggggttgggggtggggggttgggggaggcagggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccgccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctggaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatcgccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaaatatatatatacctata

SEQ ID NO: 121793 - DNA, 592 bp, Homo sapiens
  Payload ID: 3883
  Gene Symbol: C1RL
  Gene Name: complement component 1, r subcomponent-like
  ENST ID: ENST00000543933
  CDS Start-End: 18-592
cagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtgggggcactcacctgtgcaaccccagggacctggaaagacagacaggatggggaggaggttcttcagtgtatgcctgtctgcggacg

SEQ ID NO: 121794 - DNA, 532 bp, Homo sapiens
  Payload ID: 3883
  Gene Symbol: C1RL
  Gene Name: complement component 1, r subcomponent-like
  ENST ID: ENST00000534969
  CDS Start-End: 1-252
ggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgcagcagcaccaagttacatctcaccggcaatacatgagggttcaagcccaccatttttgagatccacgcttttgaatgaaagcattgccttc

SEQ ID NO: 121795 - DNA, 449 bp, Homo sapiens
  Payload ID: 3883
  Gene Symbol: C1RL
  Gene Name: complement component 1, r subcomponent-like
  ENST ID: ENST00000545280
  CDS Start-End: 18-350
cagatgtccagttccagatgcctggacccagagtgtgggggaaatatctctggagaagccctcactccaaaggctgtccaggcgcaatatctcattcgtcggttcggatccaagccagttctgtggtcagcaaggctcccctctgggcaggccccctggtcagagggagttttcagcccatcagcgaggccagcaggggctctgaggccatcaacgcacctggagacaaccctgccaaggtccagaaccactgccaggagccctattatcaggccgcggcagcaggctgtggatcatatgctgatcccatcacagaccagccctccgttaggttcagtcctcagctctgacacacaggcctgctggagaaaccctccaagcgttggtggatcttgcaccttctgtgtgcctgctgtctaactactgatgatgtggtcactgcctgatgg

SEQ ID NO: 121796 - DNA, 561 bp, Homo sapiens
  Payload ID: 3883
  Gene Symbol: C1RL
  Gene Name: complement component 1, r subcomponent-like
  ENST ID: ENST00000537833
  CDS Start-End: 1-256
tccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctggaaccaccaaactgtcttcaacagcagcagcaccaagttacatctcaccggcaatacatgagggttcaagcccaccatttttgagatccacgcttttgaatgaaagcattgccttct

SEQ ID NO: 121797 - DNA, 582 bp, Homo sapiens
  Payload ID: 3883
  Gene Symbol: C1RL
  Gene Name: complement component 1, r subcomponent-like
  ENST ID: ENST00000534950
  CDS Start-End: 1-582
ctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccga

SEQ ID NO: 121798 - DNA, 1569 bp, Homo sapiens
  Payload ID: 3883
  Gene Symbol: C1RL
  Gene Name: complement component 1, r subcomponent-like
  ENST ID: ENST00000544702
  CDS Start-End: 59-1003
accttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcagcttcaactccgagcctatttctttgcctctcctcatttacgccacaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattga

SEQ ID NO: 121799 - DNA, 813 bp, Homo sapiens
  Payload ID: 3883
  Gene Symbol: C1RL
  Gene Name: complement component 1, r subcomponent-like
  ENST ID: ENST00000545337
  CDS Start-End: 31-594
ctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtgggtgagtgtccctcctgggggtgcagggagggagcctctgttcccagccatgaccctggtatcttcaagccttaagtggaagcttgagtgacagctgaggctggggactcagggacacctgggctggatcccagccctgcccctgctggcaagcaaccctattaagagacagccgtagctgagcccccagcggttgtttccatgcagatttacaggcccagtgtttgcagatcatctcatttttaaagagatgccaaaaatccagatttttaagtaaaattataaattttcaaa

SEQ ID NO: 121800 - DNA, 1038 bp, Homo sapiens
  Payload ID: 3883
  Gene Symbol: C1RL
  Gene Name: complement component 1, r subcomponent-like
  ENST ID: ENST00000539803
  CDS Start-End: 1-200
acaaccctgccaaggtccagaaccactgccaggagccctattatcaggccgcggcagcaggggcactcacctgtgcaaccccagggacctggaaagacagacaggatggggaggaggttcttcagtgtatgcctggctgtggatcatatgctgatcccatcacagaccagccctccgttaggttcagtcctcagctctgacacacaggcctgctggagaaaccctccaagcgttggtggatcttgcaccttctgtgtgcctgctgtctaactactgatgatgtggtcactgcctgatggggaactgcatcagctctgtgaattcttgcaatctattgcctgggaaagtgtcttgcacattaaacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccagg

SEQ ID NO: 121801 - DNA, 2972 bp, Homo sapiens
  Payload ID: 3884
  Gene Symbol: C1S
  Gene Name: complement component 1, s subcomponent
  Uniprot ID: P09871
  ENST ID: ENST00000328916
  CDS Start-End: 525-2591
attaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 121802 - DNA, 2635 bp, Homo sapiens
  Payload ID: 3884
  Gene Symbol: C1S
  Gene Name: complement component 1, s subcomponent
  Uniprot ID: P09871
  ENST ID: ENST00000360817
  CDS Start-End: 277-2343
gtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctt

SEQ ID NO: 121803 - DNA, 2522 bp, Homo sapiens
  Payload ID: 3884
  Gene Symbol: C1S
  Gene Name: complement component 1, s subcomponent
  ENST ID: ENST00000402681
  CDS Start-End: 648-2213
agggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtgataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctg

SEQ ID NO: 121804 - DNA, 1034 bp, Homo sapiens
  Payload ID: 3884
  Gene Symbol: C1S
  Gene Name: complement component 1, s subcomponent
  ENST ID: ENST00000403949
  CDS Start-End: 530-1034
agacagggctgcttgaggagatgaggtgatcacggttaaagaagaggggctgtcctacatggatgatcatgatgcgccaagactgttgaaaacctgagtggaaatgggagcatcgttcttgagggcaggagagagactgataccgcgggggtggggctggtggaggacaatagaggaagaagaaaactgggagaaagtactcgattcctttggagaaaaattaggagaaagtctagagaagcaatgagggaaggatacaatttagctatagtctagaaagttagtcgaagttaactagggagggtgtgaggggcacggtgccatgtggggatgttggtgatatggccctgtgtgttatacctttgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatga

SEQ ID NO: 121805 - DNA, 3076 bp, Homo sapiens
  Payload ID: 3884
  Gene Symbol: C1S
  Gene Name: complement component 1, s subcomponent
  Uniprot ID: P09871
  ENST ID: ENST00000406697
  CDS Start-End: 629-2695
agaaaaataaaaagaatgcagcaggccaggttagcaggaacgttaagacggtgacggagaacagcaaagcctggaagcaagccgccgtggagaaggaagaactgtgctgagtacttcactctgttgcccaggctggagtgcagcggcacaatcacagctcactgcagtttcaacttcctgggttcaagtgatcctcctgcctgagcctcccaagtagctaggactataggctcctcctggctgttacactttctcagaccttccttgattatgatgacctcgaagttttgaggagtactgggaaagagtattataggatgccccctactggaatttgtcagatgtttttctcatgattatacagggattatggcttttggggaggaagatctcagagggtctcaccatgttgcccaggctgatctcaaactcctgaactcaagcaaccctcctgctttggcctcctaaagtattggtattacaggtgtgagccaccacacctggcccacaggacatggattctgaacaactggcataaatcgactggcctcaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 121806 - DNA, 2550 bp, Homo sapiens
  Payload ID: 3884
  Gene Symbol: C1S
  Gene Name: complement component 1, s subcomponent
  ENST ID: ENST00000443875
  CDS Start-End: 1-1067
gctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagaaataagtggtgatgtttattattctccagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagca

SEQ ID NO: 121807 - DNA, 573 bp, Homo sapiens
  Payload ID: 3884
  Gene Symbol: C1S
  Gene Name: complement component 1, s subcomponent
  ENST ID: ENST00000423384
  CDS Start-End: 272-573
gtcatttggctgtcccttttctccttcctcgcacaaccctgtatcagtggggcagcacttccttctcagaccgcttgtcccagggtccctgccttcccctagtgaaagaagctcctgcctccatcggtgggcgttgggagcatcagcggagatgcacgcaatgataaacagcagacagggctgcttgaggagatgaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagt

SEQ ID NO: 121808 - DNA, 667 bp, Homo sapiens
  Payload ID: 3884
  Gene Symbol: C1S
  Gene Name: complement component 1, s subcomponent
  ENST ID: ENST00000413211
  CDS Start-End: 359-667
gtcatttggctgtcccttttctccttcctcgcacaaccctgtatcagtggggcagcacttccttctcagaccgcttgtcccagggtccctgccttcccctagtgaaagaagctcctgcctccatcggtgggcgttgggagcatcagcggagatgcacgcaatgataaacagcagacagggctgcttgaggagatgaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatac

SEQ ID NO: 121809 - DNA, 661 bp, Homo sapiens
  Payload ID: 3884
  Gene Symbol: C1S
  Gene Name: complement component 1, s subcomponent
  ENST ID: ENST00000542978
  CDS Start-End: 191-661
atcttgggacatagaagttcctgaagggtatgggattcacctctacttcacccatctggacattgagctgtcagagaactacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatggg

SEQ ID NO: 121810 - DNA, 2844 bp, Homo sapiens
  Payload ID: 3884
  Gene Symbol: C1S
  Gene Name: complement component 1, s subcomponent
  ENST ID: ENST00000617865
  CDS Start-End: 418-2466
gtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagataaagatgaatgtagtggtagggctcaactctggaatcatatgtcagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtgcatctttctctgttgctcaagctggagtgcagtggtgcaatcacagctcactgtagccttgatctcttgggctcaattgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggagaagagagagagagaggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagc

SEQ ID NO: 121811 - DNA, 2850 bp, Homo sapiens
  Payload ID: 3885
  Gene Symbol: C2
  Gene Name: complement component 2
  Uniprot ID: P06681
  ENST ID: ENST00000299367
  CDS Start-End: 277-2535
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 121812 - DNA, 2835 bp, Homo sapiens
  Payload ID: 3885
  Gene Symbol: C2
  Gene Name: complement component 2
  Uniprot ID: P06681
  ENST ID: ENST00000375510
  CDS Start-End: 262-2520
acacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 121813 - DNA, 1847 bp, Homo sapiens
  Payload ID: 3885
  Gene Symbol: C2
  Gene Name: complement component 2
  ENST ID: ENST00000383177
  CDS Start-End: 1-1580
tgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttca

SEQ ID NO: 121814 - DNA, 1895 bp, Homo sapiens
  Payload ID: 3885
  Gene Symbol: C2
  Gene Name: complement component 2
  ENST ID: ENST00000383359
  CDS Start-End: 3-1580
tgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 121815 - DNA, 2835 bp, Homo sapiens
  Payload ID: 3885
  Gene Symbol: C2
  Gene Name: complement component 2
  Uniprot ID: P06681
  ENST ID: ENST00000383362
  CDS Start-End: 262-2520
acacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 121816 - DNA, 1895 bp, Homo sapiens
  Payload ID: 3885
  Gene Symbol: C2
  Gene Name: complement component 2
  ENST ID: ENST00000383367
  CDS Start-End: 3-1580
tgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 121817 - DNA, 539 bp, Homo sapiens
  Payload ID: 3885
  Gene Symbol: C2
  Gene Name: complement component 2
  ENST ID: ENST00000439426
  CDS Start-End: 64-539
acgatgtccctaacagcgaattccaaggcgcccgtgtagcaggagaggagcaagtcggccacgatgcgtgcactgtgcatcagggagacctgcagctccgagctggggttcagcaggaactggtcccgcaggaaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtgga

SEQ ID NO: 121818 - DNA, 561 bp, Homo sapiens
  Payload ID: 3885
  Gene Symbol: C2
  Gene Name: complement component 2
  ENST ID: ENST00000435596
  CDS Start-End: 143-561
gtattttgctgttggttctgtggatgacaggtgacaaaacaggcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggaga

SEQ ID NO: 121819 - DNA, 773 bp, Homo sapiens
  Payload ID: 3885
  Gene Symbol: C2
  Gene Name: complement component 2
  ENST ID: ENST00000411571
  CDS Start-End: 150-404
ccttttgatggtcctaattctcaaaggtaaccttaaggggagtgtattttgctgttggttctgtggatgacaggtgacaaaacaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatg

SEQ ID NO: 121820 - DNA, 605 bp, Homo sapiens
  Payload ID: 3885
  Gene Symbol: C2
  Gene Name: complement component 2
  ENST ID: ENST00000413649
  CDS Start-End: 229-605
atagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcgga

SEQ ID NO: 121821 - DNA, 576 bp, Homo sapiens
  Payload ID: 3885
  Gene Symbol: C2
  Gene Name: complement component 2
  ENST ID: ENST00000414609
  CDS Start-End: 69-576
agttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggct

SEQ ID NO: 121822 - DNA, 561 bp, Homo sapiens; identical to SEQ ID NO: 121818
  Payload ID: 3885
  Gene Symbol: C2
  Gene Name: complement component 2
  ENST ID: ENST00000458436
  CDS Start-End: 143-561

SEQ ID NO: 121823 - DNA, 435 bp, Homo sapiens
  Payload ID: 3885
  Gene Symbol: C2
  Gene Name: complement component 2
  ENST ID: ENST00000436560
  CDS Start-End: 1-435
ctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggct

SEQ ID NO: 121824 - DNA, 1895 bp, Homo sapiens; identical to SEQ ID NO: 121816
  Payload ID: 3885
  Gene Symbol: C2
  Gene Name: complement component 2
  ENST ID: ENST00000419062
  CDS Start-End: 3-1580

SEQ ID NO: 121825 - DNA, 837 bp, Homo sapiens
  Payload ID: 3885
  Gene Symbol: C2
  Gene Name: complement component 2
  ENST ID: ENST00000447952
  CDS Start-End: 229-837
atagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtg

SEQ ID NO: 121826 - DNA, 561 bp, Homo sapiens; identical to SEQ ID NO: 121818
  Payload ID: 3885
  Gene Symbol: C2
  Gene Name: complement component 2
  ENST ID: ENST00000446097
  CDS Start-End: 143-561

SEQ ID NO: 121827 - DNA, 539 bp, Homo sapiens; identical to SEQ ID NO: 121817
  Payload ID: 3885
  Gene Symbol: C2
  Gene Name: complement component 2
  ENST ID: ENST00000432285
  CDS Start-End: 64-539

SEQ ID NO: 121828 - DNA, 605 bp, Homo sapiens; identical to SEQ ID NO: 121820
  Payload ID: 3885
  Gene Symbol: C2
  Gene Name: complement component 2
  ENST ID: ENST00000440861
  CDS Start-End: 229-605

SEQ ID NO: 121829 - DNA, 1999 bp, Homo sapiens
  Payload ID: 3885
  Gene Symbol: C2
  Gene Name: complement component 2
  Uniprot ID: P06681
  ENST ID: ENST00000452323
  CDS Start-End: 69-1685
agttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccac

SEQ ID NO: 121830 - DNA, 605 bp, Homo sapiens; identical to SEQ ID NO: 121820
  Payload ID: 3885
  Gene Symbol: C2
  Gene Name: complement component 2
  ENST ID: ENST00000437162
  CDS Start-End: 229-605

SEQ ID NO: 121831 - DNA, 2835 bp, Homo sapiens; identical to SEQ ID NO: 121815
  Payload ID: 3885
  Gene Symbol: C2
  Gene Name: complement component 2
  Uniprot ID: P06681
  ENST ID: ENST00000448206
  CDS Start-End: 262-2520

SEQ ID NO: 121832 - DNA, 435 bp, Homo sapiens
  Payload ID: 3885
  Gene Symbol: C2
  Gene Name: complement component 2
  ENST ID: ENST00000455713
  CDS Start-End: 1-435
ctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggct

SEQ ID NO: 121833 - DNA, 403 bp, Homo sapiens
  Payload ID: 3885
  Gene Symbol: C2
  Gene Name: complement component 2
  ENST ID: ENST00000422470
  CDS Start-End: 1-403
ctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtgga

SEQ ID NO: 121834 - DNA, 2434 bp, Homo sapiens
  Payload ID: 3885
  Gene Symbol: C2
  Gene Name: complement component 2
  Uniprot ID: P06681
  ENST ID: ENST00000442278
  CDS Start-End: 258-2120
aaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccac

SEQ ID NO: 121835 - DNA, 576 bp, Homo sapiens; identical to SEQ ID NO: 121821
  Payload ID: 3885
  Gene Symbol: C2
  Gene Name: complement component 2
  ENST ID: ENST00000418584
  CDS Start-End: 69-576

SEQ ID NO: 121836 - DNA, 1895 bp, Homo sapiens; identical to SEQ ID NO: 121816
  Payload ID: 3885
  Gene Symbol: C2
  Gene Name: complement component 2
  ENST ID: ENST00000423826
  CDS Start-End: 3-1580

SEQ ID NO: 121837 - DNA, 576 bp, Homo sapiens; identical to SEQ ID NO: 121821
  Payload ID: 3885
  Gene Symbol: C2
  Gene Name: complement component 2
  ENST ID: ENST00000449738
  CDS Start-End: 69-576

SEQ ID NO: 121838 - DNA, 1895 bp, Homo sapiens; identical to SEQ ID NO: 121816
  Payload ID: 3885
  Gene Symbol: C2
  Gene Name: complement component 2
  ENST ID: ENST00000452763
  CDS Start-End: 3-1580

SEQ ID NO: 121839 - DNA, 561 bp, Homo sapiens; identical to SEQ ID NO: 121818
  Payload ID: 3885
  Gene Symbol: C2
  Gene Name: complement component 2
  ENST ID: ENST00000458410
  CDS Start-End: 143-561

SEQ ID NO: 121840 - DNA, 2835 bp, Homo sapiens; identical to SEQ ID NO: 121815
  Payload ID: 3885
  Gene Symbol: C2
  Gene Name: complement component 2
  Uniprot ID: P06681
  ENST ID: ENST00000411803
  CDS Start-End: 262-2520

SEQ ID NO: 121841 - DNA, 561 bp, Homo sapiens; identical to SEQ ID NO: 121818
  Payload ID: 3885
  Gene Symbol: C2
  Gene Name: complement component 2
  ENST ID: ENST00000413154
  CDS Start-End: 143-561

SEQ ID NO: 121842 - DNA, 561 bp, Homo sapiens; identical to SEQ ID NO: 121818
  Payload ID: 3885
  Gene Symbol: C2
  Gene Name: complement component 2
  ENST ID: ENST00000437394
  CDS Start-End: 143-561

SEQ ID NO: 121843 - DNA, 605 bp, Homo sapiens; identical to SEQ ID NO: 121820
  Payload ID: 3885
  Gene Symbol: C2
  Gene Name: complement component 2
  ENST ID: ENST00000449293
  CDS Start-End: 229-605

SEQ ID NO: 121844 - DNA, 1281 bp, Homo sapiens
  Payload ID: 3885
  Gene Symbol: C2
  Gene Name: complement component 2
  ENST ID: ENST00000416456
  CDS Start-End: 223-1281
atattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaag

SEQ ID NO: 121845 - DNA, 605 bp, Homo sapiens; identical to SEQ ID NO: 121820
  Payload ID: 3885
  Gene Symbol: C2
  Gene Name: complement component 2
  ENST ID: ENST00000445056
  CDS Start-End: 229-605

SEQ ID NO: 121846 - DNA, 576 bp, Homo sapiens; identical to SEQ ID NO: 121821
  Payload ID: 3885
  Gene Symbol: C2
  Gene Name: complement component 2
  ENST ID: ENST00000411885
  CDS Start-End: 69-576

SEQ ID NO: 121847 - DNA, 2835 bp, Homo sapiens; identical to SEQ ID NO: 121815
  Payload ID: 3885
  Gene Symbol: C2
  Gene Name: complement component 2
  Uniprot ID: P06681
  ENST ID: ENST00000416252
  CDS Start-End: 262-2520

SEQ ID NO: 121848 - DNA, 539 bp, Homo sapiens; identical to SEQ ID NO: 121817
  Payload ID: 3885
  Gene Symbol: C2
  Gene Name: complement component 2
  ENST ID: ENST00000452202
  CDS Start-End: 64-539

SEQ ID NO: 121849 - DNA, 1658 bp, Homo sapiens
  Payload ID: 3885
  Gene Symbol: C2
  Gene Name: complement component 2
  ENST ID: ENST00000418949
  CDS Start-End: 51-1037
cttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacagggtcaggaatcaggagtctgcctgcagcagaggccttcctgtgctcactatctctctctgtctccttcccctcctcagaaccccactcacagcccacctcctccaagaagtcttctcagattatactcatgccatgtaggaatcatgaattcaatttatacaatcataatttttattccacaagcactgttgggacactgtgctggggctgggcgacagcaaagatggaaaggctgaggtcttactttccaggaattcatcatctagaacagtggtctccacagaaaggtagtgagataacccacaggagtgaagcagaaaaatactggtgcccctgtggaataatttaaatcagattaataatttaatatttaataatttccttttaaaacttcaacattttgtgcaggctttaaaatgtgtgtgatagactgggcatggtggctagtgcctgtaatcccaacactttgggaggccgaggcaggtggatcacttgaggtcaggagtttgagaccagcctgaccaacatgatgaaaccctgtctatactaaaaatacaaaattagccacatgtgatggcgcacgcctgtaacccagctacttgggaggatgaggcaggagaatcgcttggatccgggaggtggaggttgcagtgggctgagatcacgccattgcactccagcctgggcaactagagcaaaactctgtctcaaaaaaataaataaaataaaataaaataaaataaaatatgtgtgatagaa

SEQ ID NO: 121850 - DNA, 2835 bp, Homo sapiens; identical to SEQ ID NO: 121815
  Payload ID: 3885
  Gene Symbol: C2
  Gene Name: complement component 2
  Uniprot ID: P06681
  ENST ID: ENST00000413548
  CDS Start-End: 262-2520

SEQ ID NO: 121851 - DNA, 1281 bp, Homo sapiens; identical to SEQ ID NO: 121844
  Payload ID: 3885
  Gene Symbol: C2
  Gene Name: complement component 2
  ENST ID: ENST00000428349
  CDS Start-End: 223-1281

SEQ ID NO: 121852 - DNA, 605 bp, Homo sapiens; identical to SEQ ID NO: 121820
  Payload ID: 3885
  Gene Symbol: C2
  Gene Name: complement component 2
  ENST ID: ENST00000447164
  CDS Start-End: 229-605

SEQ ID NO: 121853 - DNA, 1281 bp, Homo sapiens; identical to SEQ ID NO: 121844
  Payload ID: 3885
  Gene Symbol: C2
  Gene Name: complement component 2
  ENST ID: ENST00000421932
  CDS Start-End: 223-1281

SEQ ID NO: 121854 - DNA, 539 bp, Homo sapiens; identical to SEQ ID NO: 121817
  Payload ID: 3885
  Gene Symbol: C2
  Gene Name: complement component 2
  ENST ID: ENST00000433109
  CDS Start-End: 64-539

SEQ ID NO: 121855 - DNA, 1281 bp, Homo sapiens; identical to SEQ ID NO: 121844
  Payload ID: 3885
  Gene Symbol: C2
  Gene Name: complement component 2
  ENST ID: ENST00000417322
  CDS Start-End: 223-1281

SEQ ID NO: 121856 - DNA, 561 bp, Homo sapiens; identical to SEQ ID NO: 121818
  Payload ID: 3885
  Gene Symbol: C2
  Gene Name: complement component 2
  ENST ID: ENST00000411830
  CDS Start-End: 143-561

SEQ ID NO: 121857 - DNA, 1281 bp, Homo sapiens; identical to SEQ ID NO: 121844
  Payload ID: 3885
  Gene Symbol: C2
  Gene Name: complement component 2
  ENST ID: ENST00000435104
  CDS Start-End: 223-1281

SEQ ID NO: 121858 - DNA, 1281 bp, Homo sapiens
  Payload ID: 3885
  Gene Symbol: C2
  Gene Name: complement component 2
  ENST ID: ENST00000415985
  CDS Start-End: 223-1281
atattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaag

SEQ ID NO: 121859 - DNA, 539 bp, Homo sapiens; identical to SEQ ID NO: 121817
  Payload ID: 3885
  Gene Symbol: C2
  Gene Name: complement component 2
  ENST ID: ENST00000431247
  CDS Start-End: 64-539

SEQ ID NO: 121860 - DNA, 1895 bp, Homo sapiens; identical to SEQ ID NO: 121816
  Payload ID: 3885
  Gene Symbol: C2
  Gene Name: complement component 2
  ENST ID: ENST00000428140
  CDS Start-End: 3-1580

SEQ ID NO: 121861 - DNA, 403 bp, Homo sapiens; identical to SEQ ID NO: 121833
  Payload ID: 3885
  Gene Symbol: C2
  Gene Name: complement component 2
  ENST ID: ENST00000457446
  CDS Start-End: 1-403

SEQ ID NO: 121862 - DNA, 1609 bp, Homo sapiens
  Payload ID: 3885
  Gene Symbol: C2
  Gene Name: complement component 2
  ENST ID: ENST00000497706
  CDS Start-End: 220-1609
ttttcccctgagagcggcctcggagatggctgtgactgtcctaagctgggagctgcaagggagaattcctgtcattcctggcctcagttctgcagggaccgagggcgagacacgcctgggcccaggtgtggcgtctctgtccccatctggttttagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagg

SEQ ID NO: 121863 - DNA, 894 bp, Homo sapiens
  Payload ID: 3885
  Gene Symbol: C2
  Gene Name: complement component 2
  ENST ID: ENST00000485690
  CDS Start-End: 1-482
ccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatga

SEQ ID NO: 121864 - DNA, 2335 bp, Homo sapiens
  Payload ID: 3885
  Gene Symbol: C2
  Gene Name: complement component 2
  ENST ID: ENST00000482060
  CDS Start-End: 15-329
ctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcaggctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccaga

SEQ ID NO: 121865 - DNA, 1906 bp, Homo sapiens
  Payload ID: 3885
  Gene Symbol: C2
  Gene Name: complement component 2
  ENST ID: ENST00000469372
  CDS Start-End: 222-1742
cattttcccctgagagcggcctcggagatggctgtgactgtcctaagctgggagctgcaagggagaattcctgtcattcctggcctcagttctgcagggaccgagggcgagacacgcctgggcccaggtgtggcgtctctgtccccatctggttttagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctca

SEQ ID NO: 121866 - DNA, 536 bp, Homo sapiens
  Payload ID: 3885
  Gene Symbol: C2
  Gene Name: complement component 2
  ENST ID: ENST00000494905
  CDS Start-End: 128-536
cacttctcagacagggcggctgccgggcggaggggctcctcacttctcagatggagcggttgccaggcagagggtctcctcacttctcagacggggcggccgggcagagacgctcctcacatcccggatggggcggccgggcagagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcct

SEQ ID NO: 121867 - DNA, 542 bp, Homo sapiens
  Payload ID: 3885
  Gene Symbol: C2
  Gene Name: complement component 2
  ENST ID: ENST00000484636
  CDS Start-End: 131-385
aaagcctgaattcctcataccacactggggctggggccagagacggggcaggaggagctcttctcagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcat

SEQ ID NO: 121868 - DNA, 2456 bp, Homo sapiens
  Payload ID: 3885
  Gene Symbol: C2
  Gene Name: complement component 2
  Uniprot ID: P06681
  ENST ID: ENST00000550682
  CDS Start-End: 277-2139
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121869 - DNA, 2456 bp, Homo sapiens; identical to SEQ ID NO: 121868
  Payload ID: 3885
  Gene Symbol: C2
  Gene Name: complement component 2
  Uniprot ID: P06681
  ENST ID: ENST00000548973
  CDS Start-End: 277-2139

SEQ ID NO: 121870 - DNA, 2619 bp, Homo sapiens
  Payload ID: 3885
  Gene Symbol: C2
  Gene Name: complement component 2
  ENST ID: ENST00000548500
  CDS Start-End: 782-2302
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121871 - DNA, 2880 bp, Homo sapiens
  Payload ID: 3885
  Gene Symbol: C2
  Gene Name: complement component 2
  ENST ID: ENST00000548828
  CDS Start-End: 392-2563
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcaggctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121872 - DNA, 2456 bp, Homo sapiens; identical to SEQ ID NO: 121868
  Payload ID: 3885
  Gene Symbol: C2
  Gene Name: complement component 2
  Uniprot ID: P06681
  ENST ID: ENST00000549972
  CDS Start-End: 277-2139

SEQ ID NO: 121873 - DNA, 2880 bp, Homo sapiens
  Payload ID: 3885
  Gene Symbol: C2
  Gene Name: complement component 2
  ENST ID: ENST00000550363
  CDS Start-End: 392-2563
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacgtgaggctccctgtgggctttgctcaggctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121874 - DNA, 2456 bp, Homo sapiens
  Payload ID: 3885
  Gene Symbol: C2
  Gene Name: complement component 2
  Uniprot ID: P06681
  ENST ID: ENST00000548995
  CDS Start-End: 277-2139
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121875 - DNA, 2880 bp, Homo sapiens; identical to SEQ ID NO: 121873
  Payload ID: 3885
  Gene Symbol: C2
  Gene Name: complement component 2
  ENST ID: ENST00000547984
  CDS Start-End: 392-2563

SEQ ID NO: 121876 - DNA, 2880 bp, Homo sapiens; identical to SEQ ID NO: 121873
  Payload ID: 3885
  Gene Symbol: C2
  Gene Name: complement component 2
  ENST ID: ENST00000550045
  CDS Start-End: 392-2563

SEQ ID NO: 121877 - DNA, 2456 bp, Homo sapiens; identical to SEQ ID NO: 121868
  Payload ID: 3885
  Gene Symbol: C2
  Gene Name: complement component 2
  Uniprot ID: P06681
  ENST ID: ENST00000551648
  CDS Start-End: 277-2139

SEQ ID NO: 121878 - DNA, 2880 bp, Homo sapiens; identical to SEQ ID NO: 121873
  Payload ID: 3885
  Gene Symbol: C2
  Gene Name: complement component 2
  ENST ID: ENST00000552638
  CDS Start-End: 392-2563

SEQ ID NO: 121879 - DNA, 2619 bp, Homo sapiens
  Payload ID: 3885
  Gene Symbol: C2
  Gene Name: complement component 2
  ENST ID: ENST00000548250
  CDS Start-End: 782-2302
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121880 - DNA, 2880 bp, Homo sapiens; identical to SEQ ID NO: 121873
  Payload ID: 3885
  Gene Symbol: C2
  Gene Name: complement component 2
  ENST ID: ENST00000549997
  CDS Start-End: 392-2563

SEQ ID NO: 121881 - DNA, 2456 bp, Homo sapiens; identical to SEQ ID NO: 121868
  Payload ID: 3885
  Gene Symbol: C2
  Gene Name: complement component 2
  Uniprot ID: P06681
  ENST ID: ENST00000551081
  CDS Start-End: 277-2139

SEQ ID NO: 121882 - DNA, 2059 bp, Homo sapiens
  Payload ID: 3885
  Gene Symbol: C2
  Gene Name: complement component 2
  ENST ID: ENST00000618948
  CDS Start-End: 222-1742
cattttcccctgagagcggcctcggagatggctgtgactgtcctaagctgggagctgcaagggagaattcctgtcattcctggcctcagttctgcagggaccgagggcgagacacgcctgggcccaggtgtggcgtctctgtccccatctggttttagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121883 - DNA, 2002 bp, Homo sapiens
  Payload ID: 3885
  Gene Symbol: C2
  Gene Name: complement component 2
  Uniprot ID: P06681
  ENST ID: ENST00000621558
  CDS Start-End: 69-1685
agttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatc

SEQ ID NO: 121884 - DNA, 2002 bp, Homo sapiens; identical to SEQ ID NO: 121883
  Payload ID: 3885
  Gene Symbol: C2
  Gene Name: complement component 2
  Uniprot ID: P06681
  ENST ID: ENST00000615380
  CDS Start-End: 69-1685

SEQ ID NO: 121885 - DNA, 2059 bp, Homo sapiens; identical to SEQ ID NO: 121882
  Payload ID: 3885
  Gene Symbol: C2
  Gene Name: complement component 2
  ENST ID: ENST00000615801
  CDS Start-End: 222-1742

SEQ ID NO: 121886 - DNA, 2059 bp, Homo sapiens; identical to SEQ ID NO: 121882
  Payload ID: 3885
  Gene Symbol: C2
  Gene Name: complement component 2
  ENST ID: ENST00000613837
  CDS Start-End: 222-1742

SEQ ID NO: 121887 - DNA, 2002 bp, Homo sapiens; identical to SEQ ID NO: 121883
  Payload ID: 3885
  Gene Symbol: C2
  Gene Name: complement component 2
  Uniprot ID: P06681
  ENST ID: ENST00000612228
  CDS Start-End: 69-1685

SEQ ID NO: 121888 - DNA, 2059 bp, Homo sapiens; identical to SEQ ID NO: 121882
  Payload ID: 3885
  Gene Symbol: C2
  Gene Name: complement component 2
  ENST ID: ENST00000614291
  CDS Start-End: 222-1742

SEQ ID NO: 121889 - DNA, 2002 bp, Homo sapiens; identical to SEQ ID NO: 121883
  Payload ID: 3885
  Gene Symbol: C2
  Gene Name: complement component 2
  Uniprot ID: P06681
  ENST ID: ENST00000618254
  CDS Start-End: 69-1685

SEQ ID NO: 121890 - DNA, 5263 bp, Homo sapiens
  Payload ID: 3886
  Gene Symbol: C3
  Gene Name: complement component 3
  Uniprot ID: P01024
  ENST ID: ENST00000245907
  CDS Start-End: 94-5085
agataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctcacgtgtctggagttctttgccaagagggagaggctgaaatccccagccgcctcacctgcagctcagctccatcctacttgaaacctcacctgttcccaccgcattttctcctggcgttcgcctgctagtgtg

SEQ ID NO: 121891 - DNA, 585 bp, Homo sapiens
  Payload ID: 3886
  Gene Symbol: C3
  Gene Name: complement component 3
  ENST ID: ENST00000602229
  CDS Start-End: 1-301
cttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaagtgagtgctttccctgcgcgtgcgcgcgaccgcccgactgccccgcccatgccacgcccacaccattgtcacgcccctgcgccacgcccacaccacgccccttcctgacctgccattcttccctccagcctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattccccc

SEQ ID NO: 121892 - DNA, 576 bp, Homo sapiens
  Payload ID: 3886
  Gene Symbol: C3
  Gene Name: complement component 3
  ENST ID: ENST00000596548
  CDS Start-End: 1-576
atcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacaggtataccctctcccatctttctctcttctgtgtttctagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctg

SEQ ID NO: 121893 - DNA, 303 bp, Homo sapiens
  Payload ID: 3886
  Gene Symbol: C3
  Gene Name: complement component 3
  ENST ID: ENST00000601008
  CDS Start-End: 1-303
aacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagacgaagagaaccagaaacaatgccaggacctcggcgccttcaccgagagcatggttgtcttt

SEQ ID NO: 121894 - DNA, 708 bp, Homo sapiens
  Payload ID: 3886
  Gene Symbol: C3
  Gene Name: complement component 3
  ENST ID: ENST00000600744
  CDS Start-End: 399-708
agggcctgcgctgctgtgggagcgagggtctctctctgtcacccaggctggagtgcagtggtgcaatctcagctcactgcaacctctgcctcccggcttcaagcgattctcctgcctcagcctcctgagtagctgggattacaggcacccaccaccacgcctggctaatttttgtactttcagtaaagacggggtttcaccatgttggccaggctggtctccaactcctggcctcaagtgatctgcctgcctcggcctcccaaagtgctgggattacagacgtgagccactgcgcctggcaaggggatgcagtttcaaaagctgaaccccaattctggagagcaagcaggtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacag

SEQ ID NO: 121895 - DNA, 2088 bp, Homo sapiens
  Payload ID: 3887
  Gene Symbol: C3AR1
  Gene Name: complement component 3a receptor 1
  Uniprot ID: Q16581
  ENST ID: ENST00000307637
  CDS Start-End: 205-1653
ctgtgaggtcagatagtggtctagagcataagacttaacttattgccggaaacagagagagaacagaagaagagaaagctcagcaaattttcttgccatacttcatgacttcactgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctgggtggtggcttttgtgatgtgcattcctgtgttcgtgtaccgggaaatcttcactacagacaaccataatagatgtggctacaaatttggtctctccagctcattagattatccagacttttatggagatccactagaaaacaggtctcttgaaaacattgttcagccgcctggagaaatgaatgataggttagatccttcctctttccaaacaaatgatcatccttggacagtccccactgtcttccaacctcaaacatttcaaagaccttctgcagattcactccctaggggttctgctaggttaacaagtcaaaatctgtattctaatgtatttaaacctgctgatgtggtctcacctaaaatccccagtgggtttcctattgaagatcacgaaaccagcccactggataactctgatgcttttctctctactcatttaaagctgttccctagcgcttctagcaattccttctacgagtctgagctaccacaaggtttccaggattattacaatttaggccaattcacagatgacgatcaagtgccaacacccctcgtggcaataacgatcactaggctagtggtgggtttcctgctgccctctgttatcatgatagcctgttacagcttcattgtcttccgaatgcaaaggggccgcttcgccaagtctcagagcaaaacctttcgagtggccgtggtggtggtggctgtctttcttgtctgctggactccataccacatttttggagtcctgtcattgcttactgacccagaaactcccttggggaaaactctgatgtcctgggatcatgtatgcattgctctagcatctgccaatagttgctttaatcccttcctttatgccctcttggggaaagattttaggaagaaagcaaggcagtccattcagggaattctggaggcagccttcagtgaggagctcacacgttccacccactgtccctcaaacaatgtcatttcagaaagaaatagtacaactgtgtgaaaatgtggagcagccaacaagcaggggctcttaggcaatcacatagtgaaagtttataagaggatgaagtgatatggtgagcagcggacttcaaaaactgtcaaagaatcaatccagcggttctcaaacggtacacagactattgacatcagcatcacctagaaacttgttagaaatgcaaattctcaagccgcatcccagacttgctgaatcggaatctctgggggttgggacccagcaagggcacttaacaaaccctcgtttctgattaatgctaaatgtaagaatcattgtaaacattagttctatttctatcccaaactaagctatgtgaaataagagaagctactttgtttttaaatgatgttgaatatttgtcgatatttccatcattaaatttttccttagcattgtctaagtcttccagattccatt

SEQ ID NO: 121896 - DNA, 567 bp, Homo sapiens
  Payload ID: 3887
  Gene Symbol: C3AR1
  Gene Name: complement component 3a receptor 1
  ENST ID: ENST00000546241
  CDS Start-End: 128-567
agacaggactcgtggagacatccaggtgctgaagccttcagctactgtctcagttttttggtaagaaaacctagacctacctgatgacttgtgcttagcctgttttgctcattatagaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcggacagtgaacacaatttggttcctccacctcaccttggcggacctcctctgctgcctctccttgcccttctcgctggctcacttggctctccagggacagtggccctacggcaggttcctatgcaagctcatcccctccatcattgtcctcaacatgtttgccagtgtcttcctgcttactgccattagcctggatcgctgtcttgtggtattcaagccaatctggtgtcagaatcatcgcaatgtagggatggcctgctctatctgtggatgtatctg

SEQ ID NO: 121897 - DNA, 2243 bp, Homo sapiens
  Payload ID: 3888
  Gene Symbol: C4BPA
  Gene Name: complement component 4 binding protein, alpha
  Uniprot ID: P04003
  ENST ID: ENST00000367070
  CDS Start-End: 195-1988
tgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggtgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaacta

SEQ ID NO: 121898 - DNA, 552 bp, Homo sapiens
  Payload ID: 3888
  Gene Symbol: C4BPA
  Gene Name: complement component 4 binding protein, alpha
  ENST ID: ENST00000424088
  CDS Start-End: 79-435
aaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatcttagatacagggtttcaccatattggctagactggtctcaaactcctgacctcaagtgatctgcctgcctcggcttcccaaagtgctgatattacagacaaacgatgcagacacccaggagagttacgtaatgggcaagtagagatt

SEQ ID NO: 121899 - DNA, 708 bp, Homo sapiens
  Payload ID: 3888
  Gene Symbol: C4BPA
  Gene Name: complement component 4 binding protein, alpha
  ENST ID: ENST00000421786
  CDS Start-End: 253-708
agggtattatgataaactctgatctggggaggaaccaggactacatagatcaaggcagttttcttctttgagaaactatcccagatatcatcatagagtcttctgctcttcctcaactaccaaaggctgtcatttccttgaagacatggatcccataacatttattctagtgctttatgacaagttggaattcaatgactatttattaaattgagttctttcagcagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagt

SEQ ID NO: 121900 - DNA, 1117 bp, Homo sapiens
  Payload ID: 3889
  Gene Symbol: C4BPB
  Gene Name: complement component 4 binding protein, beta
  Uniprot ID: P20851
  ENST ID: ENST00000243611
  CDS Start-End: 295-1053
cattcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaa

SEQ ID NO: 121901 - DNA, 1113 bp, Homo sapiens
  Payload ID: 3889
  Gene Symbol: C4BPB
  Gene Name: complement component 4 binding protein, beta
  Uniprot ID: P20851
  ENST ID: ENST00000367076
  CDS Start-End: 294-1049
attcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaa

SEQ ID NO: 121902 - DNA, 978 bp, Homo sapiens
  Payload ID: 3889
  Gene Symbol: C4BPB
  Gene Name: complement component 4 binding protein, beta
  Uniprot ID: P20851
  ENST ID: ENST00000367078
  CDS Start-End: 156-914
aagcgagaacaatgtgtcactgcaggactttggagctctcagctttggagtcagttaagaccagttccttgctgggaagccctaactctggagggacagagacaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaa

SEQ ID NO: 121903 - DNA, 949 bp, Homo sapiens
  Payload ID: 3889
  Gene Symbol: C4BPB
  Gene Name: complement component 4 binding protein, beta
  Uniprot ID: P20851
  ENST ID: ENST00000391923
  CDS Start-End: 130-888
gcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctg

SEQ ID NO: 121904 - DNA, 742 bp, Homo sapiens
  Payload ID: 3889
  Gene Symbol: C4BPB
  Gene Name: complement component 4 binding protein, beta
  ENST ID: ENST00000452902
  CDS Start-End: 200-742
caaaaagactggtcaactggatttgcattcccagaaaccaggaaatttctgaaactgagttttaaacctggcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 121905 - DNA, 5460 bp, Homo sapiens
  Payload ID: 3890
  Gene Symbol: C4A
  Gene Name: complement component 4A (Rodgers blood group)
  ENST ID: ENST00000375295
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagtggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccactgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121906 - DNA, 5460 bp, Homo sapiens
  Payload ID: 3890
  Gene Symbol: C4A
  Gene Name: complement component 4A (Rodgers blood group)
  Uniprot ID: P0C0L4
  ENST ID: ENST00000383325
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121907 - DNA, 5460 bp, Homo sapiens
  Payload ID: 3890
  Gene Symbol: C4A
  Gene Name: complement component 4A (Rodgers blood group)
  Uniprot ID: P0C0L4
  ENST ID: ENST00000421274
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121908 - DNA, 5460 bp, Homo sapiens
  Payload ID: 3890
  Gene Symbol: C4A
  Gene Name: complement component 4A (Rodgers blood group)
  Uniprot ID: P0C0L4
  ENST ID: ENST00000428956
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121909 - DNA, 5269 bp, Homo sapiens
  Payload ID: 3890
  Gene Symbol: C4A
  Gene Name: complement component 4A (Rodgers blood group)
  Uniprot ID: P0C0L4
  ENST ID: ENST00000498271
  CDS Start-End: 41-5137
gacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 121910 - DNA, 5288 bp, Homo sapiens
  Payload ID: 3890
  Gene Symbol: C4A
  Gene Name: complement component 4A (Rodgers blood group)
  ENST ID: ENST00000550297
  CDS Start-End: 52-5148
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 121911 - DNA, 5288 bp, Homo sapiens
  Payload ID: 3890
  Gene Symbol: C4A
  Gene Name: complement component 4A (Rodgers blood group)
  ENST ID: ENST00000549812
  CDS Start-End: 52-5148
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 121912 - DNA, 5148 bp, Homo sapiens
  Payload ID: 3890
  Gene Symbol: C4A
  Gene Name: complement component 4A (Rodgers blood group)
  ENST ID: ENST00000546746
  CDS Start-End: 52-5148
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagtggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtga

SEQ ID NO: 121913 - DNA, 5338 bp, Homo sapiens
  Payload ID: 3890
  Gene Symbol: C4A
  Gene Name: complement component 4A (Rodgers blood group)
  ENST ID: ENST00000616575
  CDS Start-End: 22-5256
cctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagtggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatga

SEQ ID NO: 121914 - DNA, 5460 bp, Homo sapiens
  Payload ID: 3891
  Gene Symbol: C4B
  Gene Name: complement component 4B (Chido blood group)
  Uniprot ID: P0C0L5
  ENST ID: ENST00000375177
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtcaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121915 - DNA, 5237 bp, Homo sapiens
  Payload ID: 3891
  Gene Symbol: C4B
  Gene Name: complement component 4B (Chido blood group)
  ENST ID: ENST00000425700
  CDS Start-End: 1-5097
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 121916 - DNA, 5460 bp, Homo sapiens
  Payload ID: 3891
  Gene Symbol: C4B
  Gene Name: complement component 4B (Chido blood group)
  Uniprot ID: P0C0L5
  ENST ID: ENST00000411583
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagttcagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121917 - DNA, 5460 bp, Homo sapiens
  Payload ID: 3891
  Gene Symbol: C4B
  Gene Name: complement component 4B (Chido blood group)
  Uniprot ID: P0C0L5
  ENST ID: ENST00000449788
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagactttgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121918 - DNA, 5460 bp, Homo sapiens
  Payload ID: 3891
  Gene Symbol: C4B
  Gene Name: complement component 4B (Chido blood group)
  Uniprot ID: P0C0L5
  ENST ID: ENST00000435363
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121919 - DNA, 5237 bp, Homo sapiens
  Payload ID: 3891
  Gene Symbol: C4B
  Gene Name: complement component 4B (Chido blood group)
  ENST ID: ENST00000546399
  CDS Start-End: 1-5097
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagactttgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 121920 - DNA, 5237 bp, Homo sapiens
  Payload ID: 3891
  Gene Symbol: C4B
  Gene Name: complement component 4B (Chido blood group)
  ENST ID: ENST00000548301
  CDS Start-End: 1-5097
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtcaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 121921 - DNA, 5288 bp, Homo sapiens
  Payload ID: 3891
  Gene Symbol: C4B
  Gene Name: complement component 4B (Chido blood group)
  ENST ID: ENST00000548530
  CDS Start-End: 52-5148
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagttcagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 121922 - DNA, 5460 bp, Homo sapiens
  Payload ID: 3892
  Gene Symbol: C4B_2
  Gene Name: complement component 4B (Chido blood group), copy 2
  Uniprot ID: P0C0L5
  ENST ID: ENST00000435500
  CDS Start-End: 85-5319
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 121923 - DNA, 5148 bp, Homo sapiens
  Payload ID: 3892
  Gene Symbol: C4B_2
  Gene Name: complement component 4B (Chido blood group), copy 2
  ENST ID: ENST00000552464
  CDS Start-End: 52-5148
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccagctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtga

SEQ ID NO: 121924 - DNA, 5465 bp, Homo sapiens
  Payload ID: 3893
  Gene Symbol: C5
  Gene Name: complement component 5
  Uniprot ID: P01031
  ENST ID: ENST00000223642
  CDS Start-End: 31-5061
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaa

SEQ ID NO: 121925 - DNA, 2311 bp, Homo sapiens
  Payload ID: 3894
  Gene Symbol: C5AR1
  Gene Name: complement component 5a receptor 1
  Uniprot ID: P21730
  ENST ID: ENST00000355085
  CDS Start-End: 23-1075
ggggagcccaggagaccagaacatggactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggctggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaagaagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccaccccccccacacacaccatctttccatcccaggcttttgaaaaacaaacagaaacccgtgtatctgggatatttccatatggcaataggtgtgaacagggaactcagaatacagacaagtagaaagattctcgcttaaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaacttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaagtatacatgactttaatgaggaaaataaaaatgaatattgaaa

SEQ ID NO: 121926 - DNA, 781 bp, Homo sapiens
  Payload ID: 3894
  Gene Symbol: C5AR1
  Gene Name: complement component 5a receptor 1
  ENST ID: ENST00000594787
  CDS Start-End: 730-781
cagccctcctgcacccaggtgattaaaagctttattgctcacacaaagcctgtttggtggtgtcttcacacggacgcgagtgaaagatgggatcacaggcccccaccaccacgcccaggtggagtcttgctttgtcgcccaggctggagtgcagtggtgccatcttggctcactgcaacctccacctcccgggttcaagtaattcttgtgcctcagcctcccgagtagctgggactacaggcatgcaccaccacacccagagtcttgctcagtcaaggctggagtgcattggcatgatctcagcttactgcaacctccgcctcccaggttcaagtgattctcctgcctcagtctctggagtagctgggattacaggactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgc

SEQ ID NO: 121927 - DNA, 1287 bp, Homo sapiens
  Payload ID: 3895
  Gene Symbol: C5AR2
  Gene Name: complement component 5a receptor 2
  Uniprot ID: Q9P296
  ENST ID: ENST00000600626
  CDS Start-End: 72-1085
cctgtgtgccacgtgctggacaaatcttaactcctcaaggactcccaaaaccagagacaccaggagcctgaatggggaacgattctgtcagctacgagtatggggattacagcgacctctcggaccgccctgtggactgcctggatggcgcctgcctggccatcgacccgctgcgcgtggccccgctcccactgtatgccgccatcttcctggtgggggtgccgggcaatgccatggtggcctgggtggctgggaaggtggcccgccggagggtgggtgccacctggttgctccacctggccgtggcggatttgctgtgctgtttgtctctgcccatcctggcagtgcccattgcccgtggaggccactggccgtatggtgcagtgggctgtcgggcgctgccctccatcatcctgctgaccatgtatgccagcgtcctgctcctggcagctctcagtgccgacctctgcttcctggctctcgggcctgcctggtggtctacggttcagcgggcgtgcggggtgcaggtggcctgtggggcagcctggacactggccttgctgctcaccgtgccctccgccatctaccgccggctgcaccaggagcacttcccagcccggctgcagtgtgtggtggactacggcggctcctccagcaccgagaatgcggtgactgccatccggtttctttttggcttcctggggcccctggtggccgtggccagctgccacagtgccctcctgtgctgggcagcccgacgctgccggccgctgggcacagccattgtggtggggttttttgtctgctgggcaccctaccacctgctggggctggtgctcactgtggcggccccgaactccgcactcctggccagggccctgcgggctgaacccctcatcgtgggccttgccctcgctcacagctgcctcaatcccatgctcttcctgtattttgggagggctcaactccgccggtcactgccagctgcctgtcactgggccctgagggagtcccagggccaggacgaaagtgtggacagcaagaaatccaccagccatgacctggtctcggagatggaggtgtaggctggagagacattgtgggtgtgtatcttcttatctcatttcacaagactggcttcaggcatagctggatccaggagctcaatgatgtcttcattttattccttccttcattcaacagatatccatcatgcacttgctatgtgcaaggcctttttaggcactagagatatagcagtgaccaaaacagacacaaatcctgccc

SEQ ID NO: 121928 - DNA, 6746 bp, Homo sapiens
  Payload ID: 3895
  Gene Symbol: C5AR2
  Gene Name: complement component 5a receptor 2
  Uniprot ID: Q9P296
  ENST ID: ENST00000595464
  CDS Start-End: 219-1232
tataaagattcactgggactggtgaggtggcagtgctcagcagcatccgacaggagccctggcaaacaggacggatttccaggactctaccagctgccagacacggcagggagagaccccagacctcctgggtcctggctgtgggcccggattgggctcccaagtggcgtttgactcacgtggggacactcttggaagagacgacaccaggagcctgaatggggaacgattctgtcagctacgagtatggggattacagcgacctctcggaccgccctgtggactgcctggatggcgcctgcctggccatcgacccgctgcgcgtggccccgctcccactgtatgccgccatcttcctggtgggggtgccgggcaatgccatggtggcctgggtggctgggaaggtggcccgccggagggtgggtgccacctggttgctccacctggccgtggcggatttgctgtgctgtttgtctctgcccatcctggcagtgcccattgcccgtggaggccactggccgtatggtgcagtgggctgtcgggcgctgccctccatcatcctgctgaccatgtatgccagcgtcctgctcctggcagctctcagtgccgacctctgcttcctggctctcgggcctgcctggtggtctacggttcagcgggcgtgcggggtgcaggtggcctgtggggcagcctggacactggccttgctgctcaccgtgccctccgccatctaccgccggctgcaccaggagcacttcccagcccggctgcagtgtgtggtggactacggcggctcctccagcaccgagaatgcggtgactgccatccggtttctttttggcttcctggggcccctggtggccgtggccagctgccacagtgccctcctgtgctgggcagcccgacgctgccggccgctgggcacagccattgtggtggggttttttgtctgctgggcaccctaccacctgctggggctggtgctcactgtggcggccccgaactccgcactcctggccagggccctgcgggctgaacccctcatcgtgggccttgccctcgctcacagctgcctcaatcccatgctcttcctgtattttgggagggctcaactccgccggtcactgccagctgcctgtcactgggccctgagggagtcccagggccaggacgaaagtgtggacagcaagaaatccaccagccatgacctggtctcggagatggaggtgtaggctggagagacattgtgggtgtgtatcttcttatctcatttcacaagactggcttcaggcatagctggatccaggagctcaatgatgtcttcattttattccttccttcattcaacagatatccatcatgcacttgctatgtgcaaggcctttttaggcactagagatatagcagtgaccaaaacagacacaaatcctgccctcagggagctgatattcttctagtggaggaagacagactataaacaaagatatatagggccatttgcggtggctcacgcctgtaattccagggctttgggaggctgaggcaggtagatcacttgaggtcaggacttcaagaccagcctagccaatatggtgaaaccctgtctctactaaaaatacaaaaattagccgggcatggtggcgcatgcctgtagtcccagctacttgggaggctgaggcagaagaatcgttttgaacccgggaggcagaggtgacagtgagccaagattgagcccctgcactccagcctgggcgacagagcgagactccgtctcaaaaaataaataaataaaagattctatttatttatttatttttttgagatggagtctcgctctgtcgcccaggctggagtgcagtggcacaatctcggctcactgcaagctccgcctcctgagttcacgccattctcctgcctcagcctcctgagtagctgggactacaggcgcccgccaccatgcccagctaatttttgtatttttagtagagaaggggtttcaccttgttagccaggatggtcttgatctcctgacctggtgatccacccgcctcagcctcccaaagtgctgggattacaggcgtgagccaccgcacccggccaaaagattttaataggatccctctggttgctggtggaggtgagagtatggtgtaggggcagtgaagatcccagagaggaggctactgtaatggtccaagcaggaggtgatagcgatttggatcagggtaacagagctgaggtggtgagaggctgacaggtcatgcatctattttgaaggaaaggccaagtccaggctccttagctcggcattcaaggcttctctccaccactggacacacttactctctagcttctcagaccctgtagcaatcagaatcatgacccccggtgatgtccacatcttaatcccctgaacctgtgaagaggtgaccttccatggcaaaagggactttgcaggtgagattaagtaaaggatcttgagaaggggtggttatcctggattgtctgggtgggctcaatggagtcacgagggtccttttaagagggaggcaggagggtcagggtcagtcacaggaggtgacaacggaagcagatgtcatagtgacgtgaggaggtgccaagaaatgcaggcagcttccagaagctgaaacagacaaggaaacagattctctctgaagctcccagaaggaacacagacctcctgacacttttagacctctgatccgcagacctttaagaaaatacatttgtattgttttaagtcactatgtttggggtgatttgttatagcagccgtgggaagctaatacacacccttcgggctatattcacgcttctgcatctttcctgaagctgtgccactggctggaatgtccttctgatctatgttgtgcagttcaacaatcaagagccatctgtggctattcaaattcgaatcaattggccaggcctggtggctcctgcctataatctcagcactttgggaggccgaggtgggaggattgcatgagcccaggagtttgagaccagcctgggcgacatagcaagaccccatctctacaaaaaatacaaaaattagccagacgtggtggggcgtgcctgtagttccagctactgaggagggagttgcttgaatccttctgcttcaatcctccttaaagcaggtagattgcttgagcccgggaagtggagtttgcagtgagcttagatcacaccgctgcactccagcctggatgtcagaatgagactccatctcaaaaaaaaaaagaaagaaagaataaattttcatttcaaatttagttcctcgggcacactggccatagttcaagtgctcagtagccacatatggctggtgactgccatattcgacagcacagctatagaacattgccatcataacagagatttctgttacaaaatgctgttctagaatttacttttgaactctacctgctcagatcttttaaattacatggtaggccaggcatggtggctcacgcctgtgatcccagcactttcggaggcccagtcgggaggatcccttgagcccagaagctggagacctgcctgggcaacagagcaagaccccatctctacaaaaataaaaaaaagaaaattagcctggtttggtggcacatgcctgtagtgccagctactagggagactgaagtgggaggattgcttcagcctgggaggttgaggctgcagtgagccgtgatctcatcactgcactctagcctaggtgacggagcgggaccctgccgctaaataaataaataaataaataacatagtagtgatacctgtgtctgcggtcattactccagaacagcacttcacatatagtttctcctttaaggtcattctcacaacagcccagggagatagggtggcatgcttcattttataagctgaggtcctgggaggggaggtcatttacccaagatcacacagcaagaacaccagacagctggaatttgatcccagttttgactccaatgctcttgctcttcatcatcaataatttccttcaaggcgtccctcaaatgtcacttcctccaggaagccctccctgatttatgctccttccagaaagaatgggctcttcctttctctgagtctctggaacacaaggtcccagctaaactgtaaattccccaagggtaacaactggactaattttttttaatttaatttaattttatttttttgagatgaagtcttgctctgtcacccaggctggattgtagtggcacgatctcggctgaccgcaacctccacctcccgggttcaagcgattcttatgcctcagcctcccgagtagctgggattacaggcgctgccaccacacttggctaatttttgtatttttagtagagacagggtttcaccatgttggccaggctggtctcgaactcctgacctcaggtgatccacccaccttggcctcccaaagtgctgggaatacaggcatgagccaccgttcccggccttatccttgacttagaatacctaacctcctgggaatgcagcccataggtctcagccttatttcacccagctcctgttcaagatggagtcactctggttcacatgcctctgacatttccccgctcccttttataagagaacctttaatcctaagggttgtagagggaggaagatacaacttctgtgacttcttcaggctggacaggggtgacgatatacctgcctaactcttaggatctattggattcagggtagacaggagctcagtcagaaagcactggtatcactttttttttttttttttttttttgagacggagtttcactcttgttgcccaggctggagtgcaatggcacgatctcagctcaccacagcctccgcctcccaggttcaagcgattctcctgcctcagcctccccagtagctgggactacaggcgtgtgccaccaaacccagctaatgtttttttttttttatttttagtagagacggggtttctccatgttggccaggctggtctcgaactcccgacctcaggtgatccacccgcctcggcctcccaaagtgctgggattacagacatgagccaccacgcccggcctgatattttattacttagtattttactctgaattatcatgcgtgaattaagaccaaggctgtcttgtaaaataaaatttgttgtggaacaatttatacagctcctttgaggtaggaggcaggactcaactctggagatggggctcggctcgaatattggaccaaattgaggaccagctaaaacagggaggaggctgaagcaacttattatttttatttatttttattttttggagaaggagtcttgctctgttacccaggctggagtgcagtgacacgatctcggctcactgcaacctccaccttccggattcaagtgattctcctgccgcagcctcccgagtagctgggactacaggcgcatgccaccatgcccagctaatatttttgtattttttagtagagatggggtttcgccatattagccaggctggtcttgaactcctgactcaggtgatctgcccacctcggcctcccaaagtgctgggattacaggtgtgggccaccacgcctggcccgaagcaactttctatgacacgcctaccagtgtgccatgtcagtttgccattgccatggcaacacacccaggagttactgccccttcccatggcaatgaccccatgacccagaagttactgccccttccctagatatttctgcataaactgccccttaatctacatgtaattaaaaataggtataggctatttttatacctatataaataggtataggctaaaaataggtataggctgggcgtggtggctcatgtctgtaatcccagtactttgggaggccaatgcaggtggatcacctgaggtcaggagatcaagaccatcctggctaacatagtgaaaccctgtctctactaaaaatacaaaaaattagccaggcgtgttggcgggagcctgtagactcagctactcgggaggttgaggcaggagaatggcgtgaacccaggaggcggagcttgcagtgagccgagatcacaccactgcactccagcctgggtgacagagcaagactccgtctaaaaaaaaaaaatagtaagaaagaaggaaagacacaaagacagaaagaaggaaggaaagaaagcaagctgttttcccctgccttgcccctgctcacctttgaattcttttctgggcaaagccaagaaccctcgtgggctaaaaccccgctttggggcttaaagtttgcaaaatcctcccattaatctattgggaccagttgccacttaggagcattctttgataacttttacaaaacatcttttgtggtttttgaaatgttttcattttgtagatcattagcccttcttttttgaactggaatacatttcacgggaattttcaaatttaagtctgtgcaatgttacataaaatacctttgattattaaaagccatctgttttgctataacttcccttttttgttctaaagtttgtctatttctgctatttgtttttttaccatagaaatattgatttccttaagttttcaaagaaccaagttattaataatttctctaagaactagtctcaagcttgctatacaatcctatggttgatagactgtggctttcttgttgatttccatttgttgttcatttcctccaattttccttttttaaaaattataattattgtttggatta

SEQ ID NO: 121929 - DNA, 3661 bp, Homo sapiens
  Payload ID: 3896
  Gene Symbol: C6
  Gene Name: complement component 6
  Uniprot ID: P13671
  ENST ID: ENST00000263413
  CDS Start-End: 266-3070
ctaaaatatacccgtctctcttaattttgtatgtcttcaacataacattcattaaattttattctgaaactgagtcttaaaaactgaaatacttttaaagagagatgtttctagcttaaatatttcatcatatagtaagattcctgctgagagctcataataagaaatatgaaaccagttactctggacttggattttgatgtgctgaagtatctgctggtatttcttcaagtcatagatgcataggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgcgcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgacgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcgcaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagc

SEQ ID NO: 121930 - DNA, 3551 bp, Homo sapiens
  Payload ID: 3896
  Gene Symbol: C6
  Gene Name: complement component 6
  Uniprot ID: P13671
  ENST ID: ENST00000337836
  CDS Start-End: 156-2960
ttgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgcgcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgacgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcgcaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagc

SEQ ID NO: 121931 - DNA, 530 bp, Homo sapiens
  Payload ID: 3896
  Gene Symbol: C6
  Gene Name: complement component 6
  ENST ID: ENST00000417809
  CDS Start-End: 131-530
atgcacagaaaaaaataataagaaataagaaattcagtaagtttacatggagatgtaaaggaagaacctatagctggggataaactagagcatcctcagaaatctgttggggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgcgcctctggtagcctttcaaccatgcattccatctaagctctgca

SEQ ID NO: 121932 - DNA, 490 bp, Homo sapiens
  Payload ID: 3896
  Gene Symbol: C6
  Gene Name: complement component 6
  ENST ID: ENST00000433294
  CDS Start-End: 398-490
gtaatcatttgcaaagttcaagttccagagaacatttattttgacaaccctctaggtgttgctaggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagtgaacgttctctttagcaggtttccagcatgtcaggaaatgaaaaagagcttccagaagaatgatccaaacttctttcccagtcccagaaaagtaggaacagctgaaatgtacttgaggctattgctcacacaaaaggagcaggtgttttgagaaggggcctggaggctctcaaggcatggccagacgctctgtcttgtacttcatcctgctgaatgctctgatcaacaagggccaagcctgcttctgtgatcactatgcatggactcag

SEQ ID NO: 121933 - DNA, 4257 bp, Homo sapiens
  Payload ID: 3897
  Gene Symbol: C7
  Gene Name: complement component 7
  Uniprot ID: P10643
  ENST ID: ENST00000313164
  CDS Start-End: 360-2891
attgaactgagaacatttgctgtgtttcctgatttatagatatgtttctaagaaacatatctataacttccaaacagtcccagctggctgtagctaaggctgtgtaattgataagatgcatctggtttcaaggcacagattaagtacaaggtcaggctcttgctgtcgttggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 121934 - DNA, 2356 bp, Homo sapiens
  Payload ID: 3898
  Gene Symbol: C8A
  Gene Name: complement component 8, alpha polypeptide
  Uniprot ID: P07357
  ENST ID: ENST00000361249
  CDS Start-End: 97-1851
ttacaggtcccagcctgtagacatcttttactccaatttcctgaatagatagctttattccttcaaggtaatatagtgcggtggcttctggctgagatgtttgctgttgttttcttcatcttgtctttgatgacttgtcagcctggggtaactgcacaggagaaggtgaaccagagagtaagacgggcagctacacccgcagcagttacctgccagctgagcaactggtcagagtggacagattgctttccgtgccaggacaaaaagtaccgacaccggagcctcttgcagccaaacaagtttgggggaaccatctgcagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 121935 - DNA, 2037 bp, Homo sapiens
  Payload ID: 3899
  Gene Symbol: C8B
  Gene Name: complement component 8, beta polypeptide
  Uniprot ID: P07358
  ENST ID: ENST00000371237
  CDS Start-End: 68-1843
ggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcatgccagctcagccctacaccagtttccacctggagttcatgcaagggcaaaaggcagtgccatgcaagctgtttaaaataaagatgttaccttgtaaaatgcaagttgatttaaataaatactgagttaaaggcttaa

SEQ ID NO: 121936 - DNA, 2289 bp, Homo sapiens
  Payload ID: 3899
  Gene Symbol: C8B
  Gene Name: complement component 8, beta polypeptide
  ENST ID: ENST00000535057
  CDS Start-End: 508-2097
attattctggttggtttccagagtgacaggtaagtttttggtctgtgcaaagtctgtttccagtcactagtggctttctgtttactttgcagagctatttgctcttggggacagaagctgacagtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaagggatcaagtccaggatcatggttttcgaggatccctgtgaccgaatctagcctacatttccagcacaatggacacttgtatgactctggccttcactctctctgggcgtttcttcatgctgctttctcagtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcatgccagctcagccctacaccagtttccacctggagttcatgcaagggcaaaaggcagtgccatgcaagctgtttaaaataaagatgttaccttgtaaaatgcaagttgatttaaataaatactgagttaaaggctt

SEQ ID NO: 121937 - DNA, 2382 bp, Homo sapiens
  Payload ID: 3899
  Gene Symbol: C8B
  Gene Name: complement component 8, beta polypeptide
  ENST ID: ENST00000543257
  CDS Start-End: 571-2190
attattctggttggtttccagagtgacaggtaagtttttggtctgtgcaaagtctgtttccagtcactagtggctttctgtttactttgcagagctatttgctcttggggacagaagctgacagtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccaggtatttgaattccatctgcgagtagaagaatagtctttggttctggaacagaaaatgctgagaccaccttcgtattggccaaaagagttttttgttcttacttactcttgtaatcaagtcagatgatgaaatcacaatcactgtgtcgtaagacctattatgtattgccactctgtgccagcaacttggaaacattagctataatcctcacagctattccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcatgccagctcagccctacaccagtttccacctggagttcatgcaagggcaaaaggcagtgccatgcaagctgtttaaaataaagatgttaccttgtaaaatgcaagttgatttaaataaatactgagttaaaggctt

SEQ ID NO: 121938 - DNA, 855 bp, Homo sapiens
  Payload ID: 3900
  Gene Symbol: C8G
  Gene Name: complement component 8, gamma polypeptide
  Uniprot ID: P07360
  ENST ID: ENST00000224181
  CDS Start-End: 61-669
ctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcagtttgcagggacctggctccttgtggctgtgggctccgcttgccgtttcctgcaggagcagggccaccgggccgaggccaccacactgcatgtggctccccagggcacagccatggctgtcagtaccttccgaaagctggatgggatctgctggcaggtgcgccagctctatggagacacaggggtcctcggccgcttcctgcttcaagcccgagacgcccgaggggctgtgcacgtggttgtcgctgagaccgactaccagagtttcgctgtcctgtacctggagcgggcggggcagctgtcagtgaagctctacgcccgctcgctccctgtgagcgactcggtcctgagtgggtttgagcagcgggtccaggaggcccacctgactgaggaccagatcttctacttccccaagtacggcttctgcgaggctgcagaccagttccacgtcctggacgaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctc

SEQ ID NO: 121939 - DNA, 567 bp, Homo sapiens
  Payload ID: 3900
  Gene Symbol: C8G
  Gene Name: complement component 8, gamma polypeptide
  ENST ID: ENST00000371634
  CDS Start-End: 76-567
agagtagactctgtcctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcagtttgcagggacctggctccttgtggctgtgggctccgcttgccgtttcctgcaggagcagggccaccgggccgaggccaccacactgcatgtggctccccagggcacagccatggctgtcagtaccttccgaaagctggatgggatctgctggcaggtgcgccagctctatggagacacaggggtcctcggccgcttcctgcttcaagcccgagacgcccgaggggctgtgcacgtggttgtcgctgagaccgactaccagagtttcgctgtcctgtacctggagcgggcggggcagctgtcagtgaagctctacggggcccagggagtagtgacagacaggcctggtgtggga

SEQ ID NO: 121940 - DNA, 2713 bp, Homo sapiens
  Payload ID: 3901
  Gene Symbol: C9
  Gene Name: complement component 9
  Uniprot ID: P02748
  ENST ID: ENST00000263408
  CDS Start-End: 97-1776
aaacaatgcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataatttttttttaaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagtttggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaa

SEQ ID NO: 121941 - DNA, 1921 bp, Homo sapiens
  Payload ID: 3902
  Gene Symbol: CFB
  Gene Name: complement factor B
  ENST ID: ENST00000375443
  CDS Start-End: 154-1921
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggcc

SEQ ID NO: 121942 - DNA, 1996 bp, Homo sapiens
  Payload ID: 3902
  Gene Symbol: CFB
  Gene Name: complement factor B
  ENST ID: ENST00000375455
  CDS Start-End: 229-1996
gcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggcc

SEQ ID NO: 121943 - DNA, 2502 bp, Homo sapiens
  Payload ID: 3902
  Gene Symbol: CFB
  Gene Name: complement factor B
  Uniprot ID: P00751
  ENST ID: ENST00000399981
  CDS Start-End: 154-2448
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaagaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 121944 - DNA, 2577 bp, Homo sapiens
  Payload ID: 3902
  Gene Symbol: CFB
  Gene Name: complement factor B
  Uniprot ID: P00751
  ENST ID: ENST00000433503
  CDS Start-End: 229-2523
gcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 121945 - DNA, 2577 bp, Homo sapiens; identical to SEQ ID NO: 121944
  Payload ID: 3902
  Gene Symbol: CFB
  Gene Name: complement factor B
  Uniprot ID: P00751
  ENST ID: ENST00000436692
  CDS Start-End: 229-2523

SEQ ID NO: 121946 - DNA, 2577 bp, Homo sapiens; identical to SEQ ID NO: 121944
  Payload ID: 3902
  Gene Symbol: CFB
  Gene Name: complement factor B
  Uniprot ID: P00751
  ENST ID: ENST00000419411
  CDS Start-End: 229-2523

SEQ ID NO: 121947 - DNA, 2502 bp, Homo sapiens
  Payload ID: 3902
  Gene Symbol: CFB
  Gene Name: complement factor B
  Uniprot ID: P00751
  ENST ID: ENST00000424727
  CDS Start-End: 154-2448
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 121948 - DNA, 2577 bp, Homo sapiens
  Payload ID: 3902
  Gene Symbol: CFB
  Gene Name: complement factor B
  Uniprot ID: P00751
  ENST ID: ENST00000419920
  CDS Start-End: 229-2523
gcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaagaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 121949 - DNA, 2577 bp, Homo sapiens; identical to SEQ ID NO: 121944
  Payload ID: 3902
  Gene Symbol: CFB
  Gene Name: complement factor B
  Uniprot ID: P00751
  ENST ID: ENST00000427888
  CDS Start-End: 229-2523

SEQ ID NO: 121950 - DNA, 2502 bp, Homo sapiens; identical to SEQ ID NO: 121947
  Payload ID: 3902
  Gene Symbol: CFB
  Gene Name: complement factor B
  Uniprot ID: P00751
  ENST ID: ENST00000426239
  CDS Start-End: 154-2448

SEQ ID NO: 121951 - DNA, 2502 bp, Homo sapiens; identical to SEQ ID NO: 121947
  Payload ID: 3902
  Gene Symbol: CFB
  Gene Name: complement factor B
  Uniprot ID: P00751
  ENST ID: ENST00000455591
  CDS Start-End: 154-2448

SEQ ID NO: 121952 - DNA, 2502 bp, Homo sapiens; identical to SEQ ID NO: 121947
  Payload ID: 3902
  Gene Symbol: CFB
  Gene Name: complement factor B
  Uniprot ID: P00751
  ENST ID: ENST00000417261
  CDS Start-End: 154-2448

SEQ ID NO: 121953 - DNA, 2862 bp, Homo sapiens
  Payload ID: 3902
  Gene Symbol: CFB
  Gene Name: complement factor B
  Uniprot ID: P00751
  ENST ID: ENST00000425368
  CDS Start-End: 514-2808
ggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 121954 - DNA, 768 bp, Homo sapiens
  Payload ID: 3902
  Gene Symbol: CFB
  Gene Name: complement factor B
  ENST ID: ENST00000460718
  CDS Start-End: 97-357
agtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgt

SEQ ID NO: 121955 - DNA, 589 bp, Homo sapiens
  Payload ID: 3902
  Gene Symbol: CFB
  Gene Name: complement factor B
  ENST ID: ENST00000498317
  CDS Start-End: 1-205
ccctcggttcctttgtactggaggagtgagtccctatgctgaccccaatacttgcagaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacacaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 121956 - DNA, 940 bp, Homo sapiens
  Payload ID: 3902
  Gene Symbol: CFB
  Gene Name: complement factor B
  ENST ID: ENST00000483004
  CDS Start-End: 1-917
ctgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggc

SEQ ID NO: 121957 - DNA, 586 bp, Homo sapiens
  Payload ID: 3902
  Gene Symbol: CFB
  Gene Name: complement factor B
  ENST ID: ENST00000475617
  CDS Start-End: 154-586
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacct

SEQ ID NO: 121958 - DNA, 1201 bp, Homo sapiens
  Payload ID: 3903
  Gene Symbol: CFD
  Gene Name: complement factor D (adipsin)
  Uniprot ID: P00746
  ENST ID: ENST00000327726
  CDS Start-End: 48-809
ccccagggccctgcctgggtcagtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaaattctgc

SEQ ID NO: 121959 - DNA, 809 bp, Homo sapiens
  Payload ID: 3903
  Gene Symbol: CFD
  Gene Name: complement factor D (adipsin)
  ENST ID: ENST00000592860
  CDS Start-End: 27-809
agtgtctcagccacagcggcttcaccatgcacagctgggagcgcctggcagttctggtcctcctaggagcggccgcctgcggtgaggaggcctgggcctgggcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctag

SEQ ID NO: 121960 - DNA, 1201 bp, Homo sapiens; identical to SEQ ID NO: 121958
  Payload ID: 3903
  Gene Symbol: CFD
  Gene Name: complement factor D (adipsin)
  Uniprot ID: P00746
  ENST ID: ENST00000617994
  CDS Start-End: 48-809

SEQ ID NO: 121961 - DNA, 809 bp, Homo sapiens; identical to SEQ ID NO: 121959
  Payload ID: 3903
  Gene Symbol: CFD
  Gene Name: complement factor D (adipsin)
  ENST ID: ENST00000632706
  CDS Start-End: 27-809

SEQ ID NO: 121962 - DNA, 1454 bp, Homo sapiens
  Payload ID: 3904
  Gene Symbol: CFH
  Gene Name: complement factor H
  ENST ID: ENST00000359637
  CDS Start-End: 63-1220
gaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaa

SEQ ID NO: 121963 - DNA, 4127 bp, Homo sapiens
  Payload ID: 3904
  Gene Symbol: CFH
  Gene Name: complement factor H
  Uniprot ID: P08603
  ENST ID: ENST00000367429
  CDS Start-End: 241-3936
acagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcaaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattaaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatgaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattgtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtggcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaatggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttgaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataaaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaa

SEQ ID NO: 121964 - DNA, 1658 bp, Homo sapiens
  Payload ID: 3904
  Gene Symbol: CFH
  Gene Name: complement factor H
  ENST ID: ENST00000630130
  CDS Start-End: 74-1423
aattcttggaagaggagaactggacgttgtgaacagagttagctggtaaatgtcctcttaaaagatccaaaaaatgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaa

SEQ ID NO: 121965 - DNA, 1271 bp, Homo sapiens
  Payload ID: 3905
  Gene Symbol: CFHR1
  Gene Name: complement factor H-related 1
  Uniprot ID: Q03591
  ENST ID: ENST00000320493
  CDS Start-End: 89-1081
atgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaa

SEQ ID NO: 121966 - DNA, 1070 bp, Homo sapiens
  Payload ID: 3905
  Gene Symbol: CFHR1
  Gene Name: complement factor H-related 1
  ENST ID: ENST00000367424
  CDS Start-End: 65-880
agattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaa

SEQ ID NO: 121967 - DNA, 1059 bp, Homo sapiens
  Payload ID: 3906
  Gene Symbol: CFHR2
  Gene Name: complement factor H-related 2
  Uniprot ID: P36980
  ENST ID: ENST00000367415
  CDS Start-End: 101-913
aaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaa

SEQ ID NO: 121968 - DNA, 1020 bp, Homo sapiens
  Payload ID: 3906
  Gene Symbol: CFHR2
  Gene Name: complement factor H-related 2
  ENST ID: ENST00000476712
  CDS Start-End: 110-874
agtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaa

SEQ ID NO: 121969 - DNA, 1645 bp, Homo sapiens
  Payload ID: 3907
  Gene Symbol: CFHR3
  Gene Name: complement factor H-related 3
  Uniprot ID: Q02985
  ENST ID: ENST00000367425
  CDS Start-End: 93-1085
gaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattaattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgt

SEQ ID NO: 121970 - DNA, 1242 bp, Homo sapiens
  Payload ID: 3907
  Gene Symbol: CFHR3
  Gene Name: complement factor H-related 3
  ENST ID: ENST00000367427
  CDS Start-End: 75-773
aataatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattactgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaaggattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggat

SEQ ID NO: 121971 - DNA, 1043 bp, Homo sapiens
  Payload ID: 3907
  Gene Symbol: CFHR3
  Gene Name: complement factor H-related 3
  Uniprot ID: Q02985
  ENST ID: ENST00000391985
  CDS Start-End: 72-881
aatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcaattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctc

SEQ ID NO: 121972 - DNA, 1965 bp, Homo sapiens
  Payload ID: 3907
  Gene Symbol: CFHR3
  Gene Name: complement factor H-related 3
  ENST ID: ENST00000471440
  CDS Start-End: 75-773
aataatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattactgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttcccca

SEQ ID NO: 121973 - DNA, 1462 bp, Homo sapiens
  Payload ID: 3907
  Gene Symbol: CFHR3
  Gene Name: complement factor H-related 3
  ENST ID: ENST00000617219
  CDS Start-End: 72-659
aatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttccgaatcttcctctatttatattttaaataaagaaatacaatataaatgtaaaccaggatatgcaacagcagatggaaattcttcagatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaatt

SEQ ID NO: 121974 - DNA, 1292 bp, Homo sapiens
  Payload ID: 3908
  Gene Symbol: CFHR4
  Gene Name: complement factor H-related 4
  Uniprot ID: Q92496
  ENST ID: ENST00000251424
  CDS Start-End: 70-1065
tgaaagatttcaaaccccaaacagtgcaactgaaacttttgcattactatactactgagaatatctaacatgttgttactaatcaatgtcattctgaccttgtgggtttcctgtgctaatggacaagaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcattgcacacaagatggttggtcaccaacggtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattgga

SEQ ID NO: 121975 - DNA, 2178 bp, Homo sapiens
  Payload ID: 3908
  Gene Symbol: CFHR4
  Gene Name: complement factor H-related 4
  Uniprot ID: Q92496
  ENST ID: ENST00000367416
  CDS Start-End: 138-1871
aagtgaccttaaagccctagctttgtggtagtgcacttaaattcagaatcacacttggtaactaataatgaaagatttcaaaccccaaacagtgcaactgaaacttttgcattactatactactgagaatatctaacatgttgttactaatcaatgtcattctgaccttgtgggtttcctgtgctaatggacaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcattgcacacaagatggttggtcaccaacggtcccatgcctcagaacatgctcaaaatcagatgtagaaattgaaaatggattcatttctgaatcttcctctatttatattttaaatgaagaaacacaatataattgtaaaccaggatatgcaacagcagagggaaattcttcaggatcaattacatgtttgcaaaatggatggtcaacacaaccaatttgcattaaattttgtgatatgcctgtttttgagaattccagagccaagagtaatggcatgtggtttaagctccatgacacattggactatgaatgctatgatggatatgaaagcagttatggaaacaccacagattccatagtgtgtggtgaagatggctggtcccatttgccaacatgctataattcttcagaaaactgtgggcctcctccacctattagcaatggagataccacgtccttcccgcaaaaagtgtatctgccatggtcaagagtcgagtaccagtgccagtcctactatgaacttcagggttctaaatatgtaacatgtagtaatggagactggtcagaaccaccaagatgcatatcaatgaaaccttgtgagtttccagaaattcaacatggacatctatattatgagaatacgcgtagaccatactttccagtagctacaggacaatcttactcctattactgtgaccaaaattttgtgactccttcaggaagttactgggattacattcactgcacacaagatgggtggttgccaacagtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggacttcctatcaatgaattagtaagtatagaaacagataactgaatggctttctgcatattgtacagtatacctagacatag

SEQ ID NO: 121976 - DNA, 1066 bp, Homo sapiens
  Payload ID: 3908
  Gene Symbol: CFHR4
  Gene Name: complement factor H-related 4
  ENST ID: ENST00000367418
  CDS Start-End: 49-1044
cagtgcaactgaaacttttgcattactatactactgagaatatctaacatgttgttactaatcaatgtcattctgaccttgtgggtttcctgtgctaatggacaagaagtgaaaccttgtgattttccagaaattcaacatggaggtctatattataagagtttgcgtagactatactttccagcagctgcaggacaatcttactcctattactgtgaccaaaattttgtgactccttcaggaagttactgggattacattcactgcacacaagatgggtggttgccaacagtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatg

SEQ ID NO: 121977 - DNA, 1601 bp, Homo sapiens
  Payload ID: 3908
  Gene Symbol: CFHR4
  Gene Name: complement factor H-related 4
  ENST ID: ENST00000608469
  CDS Start-End: 430-1035
aactgaaacttttgcattactatactactgagaatatctaacatgttgttactaattaatgtcattctcaccttgtgggtttcctatgctaatggacaagtgaaatcttgtgattttccagacattaaacatggaggtctatattatgaaagtatgtgtagaccatactttccagtagctgtaggaaaatcttactcctattactgtgatgaatcttttgagactccttcaggaagttactaggattacatttattgcacacaagatgggtggtcgccagcagtaccatgtctcagaaaacgttattttccttatttggaaaatggacataatgaaaattacggaagaaagtttgtacagggtaactctgtagaagttgccttccttcctggctgtggtcttccaaatgagcagaccacagttacatgtatggagaatggctggtctcctccttgcagatgcatccgtgtcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggacttcctatcaatgaattagtaagtatagaaacagataactgaatggctttctgcatattgtacagtatacctagacatagaaacaaaatgactttagactttatttggggaagtaataataacataaaattagatgttaaaattgtaagtgaaaataaacacactatagtattcccttattgcagccatggtcctctagatgcagttaaccaaatagggtcatttttattaaaagtagtgtttcctgccaaacactgacattacatcattatcatgatttaaaggaaaaagtactaaagaaggtgaattatcatcattttcctgtgaaaaaagaaaaga

SEQ ID NO: 121978 - DNA, 2810 bp, Homo sapiens
  Payload ID: 3909
  Gene Symbol: CFHR5
  Gene Name: complement factor H-related 5
  Uniprot ID: Q9BXR6
  ENST ID: ENST00000256785
  CDS Start-End: 110-1819
agtacattgaaattcaaagtcatgcttgtaactgttaatgaaagcagatttaaagcaacaccaccatcactggagtatttttagttatatacgattgagactaccaagcatgttgctcttattcagtgtaatcctaatctcatgggtatccactgttgggggagaaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactaaaggagaatgtcatgttccaattttagaagccaatgtagatgctcagccaaaaaaagaaagctacaaagttggagacgtgttgaaattctcctgcagaaaaaatcttataagagttggatcagactcagttcaatgttaccaatttgggtggtcacctaactttccaacatgcaaaggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttgaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttgcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttgagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctatgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggcggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagtacttaattcatctaatccctcctgtttgtctcaaattataggataactttgaaactttctgaattaacgttatttaaaaggaaatgtagatgttattttagtctctatcttcatgttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaaa

SEQ ID NO: 121979 - DNA, 1043 bp, Homo sapiens
  Payload ID: 3910
  Gene Symbol:
  Gene Name: Complement factor H-related protein 2  [Source:UniProtKB/Swiss-Prot
  Acc:P36980]
  Uniprot ID: P36980
  ENST ID: ENST00000367421
  CDS Start-End: 101-913
aaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgt

SEQ ID NO: 121980 - DNA, 2159 bp, Homo sapiens
  Payload ID: 3911
  Gene Symbol: CFI
  Gene Name: complement factor I
  Uniprot ID: P05156
  ENST ID: ENST00000394634
  CDS Start-End: 209-1960
tctttaatgggaaggccattttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtgactcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcactggatatttttaaaggtctccacagagtttatgccatattggaattttgttgtataattctcaaataaatattttggtgaagcatac

SEQ ID NO: 121981 - DNA, 2053 bp, Homo sapiens
  Payload ID: 3911
  Gene Symbol: CFI
  Gene Name: complement factor I
  ENST ID: ENST00000394635
  CDS Start-End: 81-1856
ggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcagcagctagacatcctacaattcaaggctttgcatctgtgactcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcactggatatttttaaaggtctccacagagtttatgccatattggaattttgttgtataattctcaaataaatattttggtgaagcat

SEQ ID NO: 121982 - DNA, 667 bp, Homo sapiens
  Payload ID: 3911
  Gene Symbol: CFI
  Gene Name: complement factor I
  ENST ID: ENST00000510800
  CDS Start-End: 8-493
ctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacagtgagcgcttgtatcagtggattttctcatggctgatttaattgttctgtttgctttttgattacctaacctttctgtgtattaatttccatatgtgtaacctaagaaaattaactatgtgcatcatagcattgttatgaggatgatatgcattcatgtttacccaacacttggaacc

SEQ ID NO: 121983 - DNA, 1914 bp, Homo sapiens
  Payload ID: 3911
  Gene Symbol: CFI
  Gene Name: complement factor I
  ENST ID: ENST00000512148
  CDS Start-End: 15-1745
cgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcactggatatttttaaaggtctccacagagtttatgccatattggaattttgttgtataa

SEQ ID NO: 121984 - DNA, 1345 bp, Homo sapiens
  Payload ID: 3911
  Gene Symbol: CFI
  Gene Name: complement factor I
  ENST ID: ENST00000618244
  CDS Start-End: 209-1345
tctttaatgggaaggccattttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtgactcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactggggggaaaaatgaagcaaatctcactggatatttttaaaggtctccacagagtttatgccatattggaattttgttgtataattctcaaataa

SEQ ID NO: 121985 - DNA, 1713 bp, Homo sapiens
  Payload ID: 3912
  Gene Symbol: CFP
  Gene Name: complement factor properdin
  Uniprot ID: P27918
  ENST ID: ENST00000247153
  CDS Start-End: 243-1652
gagcaccgcacactcacttcaccctggttcaacacccccacgaggttgaccccgtcattatgttagagattatgcattttccacatagggaaactgaggctcaggggtgttaagtgactcacccaaggtcacacggctaggaagttgctgcacgctcctatgctccatttcctctgggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcg

SEQ ID NO: 121986 - DNA, 1435 bp, Homo sapiens
  Payload ID: 3912
  Gene Symbol: CFP
  Gene Name: complement factor properdin
  ENST ID: ENST00000377005
  CDS Start-End: 122-1369
aggatgccctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgtgagtgagagggcaaagtatgcctgggagggggtcattatattacaggcgggagagtcggctaccccag

SEQ ID NO: 121987 - DNA, 1592 bp, Homo sapiens
  Payload ID: 3912
  Gene Symbol: CFP
  Gene Name: complement factor properdin
  Uniprot ID: P27918
  ENST ID: ENST00000396992
  CDS Start-End: 122-1531
aggatgccctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaactagcctcttcg

SEQ ID NO: 121988 - DNA, 928 bp, Homo sapiens
  Payload ID: 3912
  Gene Symbol: CFP
  Gene Name: complement factor properdin
  ENST ID: ENST00000469388
  CDS Start-End: 428-928
agataaagcgggacctcctctctggtagaggtgcagggggcagtactcaacatgatcacagagggagcgcaggcccctcgattgttgctgccgccgctgctcctgctgctcaccctgccagccacagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccgg

SEQ ID NO: 121989 - DNA, 2181 bp, Homo sapiens
  Payload ID: 3913
  Gene Symbol: CPLX1
  Gene Name: complexin 1
  Uniprot ID: O14810
  ENST ID: ENST00000304062
  CDS Start-End: 233-637
gtcacgctcggacgcgggcggggggcggggagcgcctgcgagtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccgcgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacggggggctgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttca

SEQ ID NO: 121990 - DNA, 497 bp, Homo sapiens
  Payload ID: 3913
  Gene Symbol: CPLX1
  Gene Name: complexin 1
  ENST ID: ENST00000504062
  CDS Start-End: 168-497
aaaatggctgccgcctgcgttccaaaatggctgccgccgcccacctttcccgtggaggctgagcacgtcgctccccacgcttgccggcctccaggctgacgaccgccagagccgtctctgggactctgcaggcacttcccgagcccccgcaaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgccc

SEQ ID NO: 121991 - DNA, 2011 bp, Homo sapiens
  Payload ID: 3913
  Gene Symbol: CPLX1
  Gene Name: complexin 1
  ENST ID: ENST00000505203
  CDS Start-End: 127-468
agccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccgcgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacggggggctgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttc

SEQ ID NO: 121992 - DNA, 5023 bp, Homo sapiens
  Payload ID: 3914
  Gene Symbol: CPLX2
  Gene Name: complexin 2
  Uniprot ID: Q6PUV4
  ENST ID: ENST00000359546
  CDS Start-End: 644-1048
ggggttggcaacagagcaggtaggtagacctgcatttggttgctggtcacagaaatggagagtgagagatatttctaagtcaggatgccctagtggcagacccccaagtcctcgaacttcagggcagaactgcctgggtgggaactctcccatgtctccttgatttcactgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcagaatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggatcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtagaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccccgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagc

SEQ ID NO: 121993 - DNA, 826 bp, Homo sapiens
  Payload ID: 3914
  Gene Symbol: CPLX2
  Gene Name: complexin 2
  Uniprot ID: Q6PUV4
  ENST ID: ENST00000393745
  CDS Start-End: 297-701
catctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccct

SEQ ID NO: 121994 - DNA, 557 bp, Homo sapiens
  Payload ID: 3914
  Gene Symbol: CPLX2
  Gene Name: complexin 2
  ENST ID: ENST00000509837
  CDS Start-End: 225-557
agctggaggcggggagagccttgatcaaagtcaggcaggggagcacagcggcttcctgacgctggacccaggtggggacagagcggccctgtgaagtcaaagagaatgttgctttgttcagctctcactgggaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggag

SEQ ID NO: 121995 - DNA, 576 bp, Homo sapiens
  Payload ID: 3914
  Gene Symbol: CPLX2
  Gene Name: complexin 2
  Uniprot ID: Q6PUV4
  ENST ID: ENST00000515094
  CDS Start-End: 164-568
aatctccgccggagccggggaaaggtggcattgccatttctctcttagagaggaggaaactggggactcgagcaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcct

SEQ ID NO: 121996 - DNA, 469 bp, Homo sapiens
  Payload ID: 3914
  Gene Symbol: CPLX2
  Gene Name: complexin 2
  ENST ID: ENST00000515502
  CDS Start-End: 450-469
cgggcgccctcgtcggccgcggaggagctgcagcctccaacagaagggaaaacggacacctgtggaggggaagaaacgtgtccaagatcattcacacagagcgtcagctctggggtcagaacccagctcccaaggctttccgtgtccagaccacctccctcacctggttggccagcctccacctgatgagccgggcaggctgcaagtggcaagttccctgggaaggtgtggtccctgccatgctatctgctctgctcagcgactgaaggtgcccgcatcccagctctgccaggaagcaaagttacagatgagaaaactgaagctcagagagtgaaaggacttgcctaaagacacacagctggttgtcacatcttcccaagccaggccagccaggagcgctgcatgcaaattctgccgtgggctaaggcacgctaaccagagccggcggcatggacttcgtcatgaagca

SEQ ID NO: 121997 - DNA, 970 bp, Homo sapiens
  Payload ID: 3914
  Gene Symbol: CPLX2
  Gene Name: complexin 2
  ENST ID: ENST00000514150
  CDS Start-End: 613-970
agtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaaaggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacgg

SEQ ID NO: 121998 - DNA, 532 bp, Homo sapiens
  Payload ID: 3914
  Gene Symbol: CPLX2
  Gene Name: complexin 2
  ENST ID: ENST00000502265
  CDS Start-End: 300-532
agacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaa

SEQ ID NO: 121999 - DNA, 567 bp, Homo sapiens
  Payload ID: 3914
  Gene Symbol: CPLX2
  Gene Name: complexin 2
  ENST ID: ENST00000515025
  CDS Start-End: 455-567
aatctccgccggagccggggaaaggtggcattgccatttctctcttagagaggaggaaactggggactcgagcaggttagggccttgctgaaggtcccatggcaaataaggaaatgacggtggcgttggaaaccagatctgcctgactccaagttccaggctctttccaatgctcctggcttcaatcaaatctgaacaatagggtcaagatgaaggctttaaaatagggaccaaaccgctttcaaaaagctatttggcagcacctacgtgtctgcccagtaaatcgctctcttccatctcctttctcctccagcagggcattgggtcttgacctcagagcgatgggtgcctggtgtctgaaccagggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggca

SEQ ID NO: 122000 - DNA, 518 bp, Homo sapiens
  Payload ID: 3914
  Gene Symbol: CPLX2
  Gene Name: complexin 2
  ENST ID: ENST00000512824
  CDS Start-End: 217-429
agaagccgcggctccagctcgcctggcggaattgcacgcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataaggactgaggcttgggaggcactcctggccacctcagccagtgctgcatgatcatgagactcctgctgtctccttgcccaccccgcttcatgcgcgt

SEQ ID NO: 122001 - DNA, 2082 bp, Homo sapiens
  Payload ID: 3915
  Gene Symbol: CPLX3
  Gene Name: complexin 3
  Uniprot ID: Q8WVH0
  ENST ID: ENST00000395018
  CDS Start-End: 158-634
ggcgggcccgggcgggggcgggcggcgggcggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaa

SEQ ID NO: 122002 - DNA, 1966 bp, Homo sapiens
  Payload ID: 3916
  Gene Symbol: CPLX4
  Gene Name: complexin 4
  Uniprot ID: Q7Z7G2
  ENST ID: ENST00000299721
  CDS Start-End: 188-670
agcttacggccgacaaaccactcttctctatcagtatgcccttgaatagatgaggttgtgcaaagtcctttgctcttaaatgtattgctgtcattgagaatatttggaggttttctcttgggtttgtttggattttttttttcagcttttgtctgaattttggttttatttttctggggcagagaaaatggctttccttatgaaaagtatgataagtaaccaggtaaagaatttaggatttggtggtgggtctgaagaaaataaagaagaaggaggtgcatctgatcctgcagcagctcaagggatgactagagaggagtatgaggagtatcaaaagcaaatgattgaggagaagatggaaagagatgctgcatttacacagaaaaaggcagaaagggcatgcctcagagttcatctcagagaaaaatacaggctcccaaagagtgaaatggatgagaatcaaatccagatggctggagatgatgtggatttacctgaagatctccggaaaatggtagatgaagatcaagaagaggaagaagataaagattctattcttgggcagatacagaatctccagaacatggacttggataccataaaagaaaaagcccaggccaccttcactgaaatcaagcagacagcggagcagaagtgttccgtgatgtgaggggtgggaggggtggagggagggaaccagccatccttggaaaagaccactctcttgtgggacgtttcaagcagtacatgttttaatgtagtgaacacagttaggaaaaccacgatgatccattgacagacaataatttggttgttctaaatattcctggcagagcatttagctaacaccttgcagcgggaaccttactttccttttagttataaatgagataaactggaaaatttcagttgtaaatgatgatgcagaacacatatctgcttaaagaccttgagatgagccaggaagaaacaaaagcaaggggcatttcctctccaactttcttccttggaggccaagttctcaccctgtccaactattcgcaggacaccaggtcccttcagagagaaatgtggagagtcaaggtgtctactgggagccgggtttcccacagggagctgagtctacagactccagggcaatcaaaggtcaccacccccacccctcacctctaggatccttgaatttgtcaatgatactcatcaagtatgcttggatcctttggtccttggatgcttctcagccaagtggcggtagcacagatgtggtgaacaatgacgaattgaggcagggaatagacctcactagccctttgcaatggagatcatcgttctagtggccatgtgaagaatggaaccaagggaggcacaattagaggcagagggaaaccaggcagacggctgctctttttgagttgagcttaactctccttgtctgaacttggtgatagcaatgggaacaaagtgggtagactaacagagagcattaagaagttaaatcaatctctctctgtctcctcccaacctctctctctctttcatccccttctctccctatctctcttttttttttcttctcctgtcccttcccatcccacccctttagactaccttccagtaaatcacactgtcatttggtgccacaagctttcagggtagacactgatttttcccccctaatatctgctctctttcaaaaggaataattcaaaagacttaggacaattaccactgaaacacttcgagctatttagctaaagcccaccaaaccaaaacaaaatactgatttttttttttttttttggtgactctgttcatacagtgaataaagatctatcaaaggaaaaggaaactgagaccgaaaacttagggtctaagttgttctaaacccagggttctcaaatgtgttgtacaaaaagtttcatgtaataaaattaagcaaataaaacaaatgaatagaggtccaaaa

SEQ ID NO: 122003 - DNA, 1916 bp, Homo sapiens
  Payload ID: 3916
  Gene Symbol: CPLX4
  Gene Name: complexin 4
  ENST ID: ENST00000587244
  CDS Start-End: 83-376
ggaggttttctcttgggtttgtttggattttttttttcagcttttgtctgaattttggttttatttttctggggcagagaaaatggctttccttatgaaaagtatgataagtaaccaggtaaagaatttaggatttggtggtgggtctgaagaaaataaagaagaaggaggtgcatctgatcctgcagcagctcaagggatgactagagaggagtatgaggagtatcaaaagcaaatgattgaggagaagatggaaagagatgctgcatttacacagaaaaaggcagaaagggcatgcctcagagttcatctcagagaaaaatacaggctcccaaagtgcacagggatatgcatgtctcccccgtgttgtaggtgagactgttcatccagaatacttccagaaattggaccttctccatacagccacgatcaaggagtcgctttatactacaacttcctcacgtttggaaatgtgtgtctcccaaccatccgaagtttaatggggctttagctgtgtctaaggttggccgcaggtgggggatggaaggaggggttttctttgatccatctaatgaattaatgaattaatcagaggtggggttcagaagccaggctccttactgttgctgaagcagggctgattatgagctagcctaactgctggaaaaatgcagcttcatgctagaagaattagggacatggcccagtccattcatcttccctaatcgagttcttgggaaatacacacgtagattagcccctaacaatgacccccggctgattgcttggagtaccctccaccgtgcccacaatggtactgactagctctttatgtcctgcacaaaggaagccccaactcccccttgtcctcctctgccctgtctcccccacccccatcaccaccacccctgccctcgccagtggctgttgaagtcttttctgcttttttccccagactctgaaacaaacagtaaataaaagctaacctcacctggacttattaggaggagctgggcagttccagaggaattaactttggaaaacaaggccataaaccccttagcagcgtgtgggcaggagcttaaggaaacgctgccaatctttgtttagcggtgattatcgagatcaatttaatattggggaagtttgcataaaaagcattctcggtcagagggggaacaacaaataccaattaattatccccacagctgccctctgatcaccaccacctcagcacgtcagccacctggtctatgtcactggcagtcagaccttttcgggtgccaccaggccatttgtgggccctggaaaggtggaggaggggcggaggaggaggcaaaacctggtctgtcaggggactttccagagggtttgttaatttgccctggatgccggtacccaaagcccactctctataggctctgactttatttcttctgggagctaaactgcttctacctccgcctcttagatgcagaatccagtctcagggaaggattaaagacagactgcaggctaagatgggctttgattcttttcaaaaagatcacacactacaataataattacaaatgagctgcaggcagaaaacactggacaaggagtcagtggcctgagttctagtcctgacccttccacttaatagctgtatcactttgagcctcagtttcctcttctgtaaaatggggaccaatatgtctgtcctgctcacctcacaaggttgtgaagatcagatgacatgaagaatgtgagaagattctgaaacctacaaagtgacatgtcgagagaattgcttgagcccaggagttccaggctgcagtgagccaccatcatgccactgcactccagcctgggcaacagagagggaccctgtctctaaaataaacagacaaataaataataagtaaataaagtaa

SEQ ID NO: 122004 - DNA, 3079 bp, Homo sapiens
  Payload ID: 3917
  Gene Symbol: COG1
  Gene Name: component of oligomeric golgi complex 1
  Uniprot ID: Q8WTW3
  ENST ID: ENST00000299886
  CDS Start-End: 81-3023
gcttccgcccccaacgaagatggcggagggggcgggactaaaagggcgtaggtagatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaa

SEQ ID NO: 122005 - DNA, 4051 bp, Homo sapiens
  Payload ID: 3917
  Gene Symbol: COG1
  Gene Name: component of oligomeric golgi complex 1
  ENST ID: ENST00000438720
  CDS Start-End: 1-2887
ggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttct

SEQ ID NO: 122006 - DNA, 739 bp, Homo sapiens
  Payload ID: 3917
  Gene Symbol: COG1
  Gene Name: component of oligomeric golgi complex 1
  ENST ID: ENST00000582587
  CDS Start-End: 1-373
cgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagttctgtgccttcccctgcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatg

SEQ ID NO: 122007 - DNA, 438 bp, Homo sapiens
  Payload ID: 3917
  Gene Symbol: COG1
  Gene Name: component of oligomeric golgi complex 1
  ENST ID: ENST00000582973
  CDS Start-End: 1-81
cagctcgccccccggagcagtacgttcaactcccaagaaccccataacatcctgccactggcatccagtcagatcaggtaaaggctgccaagaggcttctgcggggcacttcgggaggccaaggtggacggatcacgtcaggagatcgagaccatcctggctaacatggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaa

SEQ ID NO: 122008 - DNA, 520 bp, Homo sapiens
  Payload ID: 3917
  Gene Symbol: COG1
  Gene Name: component of oligomeric golgi complex 1
  ENST ID: ENST00000582672
  CDS Start-End: 1-308
agaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtag

SEQ ID NO: 122009 - DNA, 506 bp, Homo sapiens
  Payload ID: 3917
  Gene Symbol: COG1
  Gene Name: component of oligomeric golgi complex 1
  ENST ID: ENST00000582512
  CDS Start-End: 1-379
cctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcagtacgatgccaactgttaagcctgcaggaatcctcctgggttgtccccccggcacgctccacagctggtgacccgacagttcctggctccttgttcagacagcttgtcagtgaagaagacaacacgtctgcaccttcattattcaa

SEQ ID NO: 122010 - DNA, 3369 bp, Homo sapiens
  Payload ID: 3917
  Gene Symbol: COG1
  Gene Name: component of oligomeric golgi complex 1
  ENST ID: ENST00000618996
  CDS Start-End: 337-3159
gcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgcccccgccccctcgcgcccgccccctcgggtaacaaacatggcccccggcggggcggaagcgcttccgcccccaacgaagatggcggagggggcgggactaaaagggcgtaggtagatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcagtacgatgccaactgttaagcctgcaggaatcctcctgggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttc

SEQ ID NO: 122011 - DNA, 2843 bp, Homo sapiens
  Payload ID: 3918
  Gene Symbol: COG2
  Gene Name: component of oligomeric golgi complex 2
  Uniprot ID: Q14746
  ENST ID: ENST00000366668
  CDS Start-End: 41-2254
ctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctccca

SEQ ID NO: 122012 - DNA, 2921 bp, Homo sapiens
  Payload ID: 3918
  Gene Symbol: COG2
  Gene Name: component of oligomeric golgi complex 2
  Uniprot ID: Q14746
  ENST ID: ENST00000366669
  CDS Start-End: 116-2332
agcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctccca

SEQ ID NO: 122013 - DNA, 2963 bp, Homo sapiens
  Payload ID: 3918
  Gene Symbol: COG2
  Gene Name: component of oligomeric golgi complex 2
  ENST ID: ENST00000534989
  CDS Start-End: 336-2375
gcacttcgcaatgagtcttttggcgtcaggtttggcgggtgcagcctggagaaagcacttctgtaaaatcgtgcgtgttacatggaaaggcctgaaagttctgggcaagtggttttgagctgcatgtcaaagccactgttacccgttcctgttaccatgcagtgcagtcagattgccagtccccttgtcggaaagaagcttgtggaccggggccttggagctcattaagtgaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctccc

SEQ ID NO: 122014 - DNA, 2784 bp, Homo sapiens
  Payload ID: 3918
  Gene Symbol: COG2
  Gene Name: component of oligomeric golgi complex 2
  ENST ID: ENST00000468893
  CDS Start-End: 103-477
gtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgataatgtctgctgtgagttgggactccccatgtctaagccattggagacagggactccatccggatgaacagtagagaagggagttttggcatcattttcaacagaaaagtgtgctaccctgtcctgtccctgctggtccaccccacagtctgtgtcaggcaccccgacttccatgctgtcttaggattgatgaactgtcataaacttcgttgattgcaccattattacctgtagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatt

SEQ ID NO: 122015 - DNA, 4498 bp, Homo sapiens
  Payload ID: 3919
  Gene Symbol: COG3
  Gene Name: component of oligomeric golgi complex 3
  Uniprot ID: Q96JB2
  ENST ID: ENST00000349995
  CDS Start-End: 113-2599
gccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaggtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcagattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaagactcagattgatggacaacttttcttaattaagcaccttttgatacttcgtgaacaaattgctccatttcacactgaattcaccattaaggaaatttccctggacctcaagaaaactagagatgcagcatttaaaatcctgaaccctatgactgtcccaagattttttaggctgaatagcaacaatgccttgatagagttcttgttggagggtactcctgagataagagaacattatcttgactctaaaaaagacgtagaccgtcatctgaaatcggcctgtgagcagtttattcagcagcagaccaagctgtttgtagaacagctggaggagttcatgacaaaggtttcagcgttaaaaacaatggccagtcagggaggccccaagtatactctctcacagcagccttgggcacaaccagcaaaggtcaatgaccttgcggcaactgcatataagacaataaaaacaaagctgcctgtgacattgagaagtatgtccttgtacctatccaataaagataccgagttcatcttgtttaaacctgtgaggaataatattcagcaagtcttccagaagttccacgctctgttaaaggaagagttcagccctgaagacatccagatcattgcctgtccatctatggaacagctgagccttctgctgttggtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttgctaaaacgtgaaacactgtaacacttttaaccactgagcattccacagtgaaatgttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttg

SEQ ID NO: 122016 - DNA, 679 bp, Homo sapiens
  Payload ID: 3919
  Gene Symbol: COG3
  Gene Name: component of oligomeric golgi complex 3
  ENST ID: ENST00000486940
  CDS Start-End: 1-206
agattgatggacaacttttcttaattaagcaccttttgatacttcgtgaacaaattgctccatttcacactgaattcaccattaaggaaatttccctggacctcaagaaaactagaggtttcagcgttaaaaacaatggccagtcagggaggccccaagtatactctctcacagcagccttgggcacaaccagcaaaggtcaatgaccttgcggcaactgcatataagacaataaaaacaaagctgcctgtgacattgagaagtatgtccttgtacctatccaataaagataccgagttcatcttgtttaaacctgtgaggaataatattcagcaagtcttccagaagttccacgctctgttaaaggaagagttcagccctgaagacatccagatcattgcctgtccatctatggaacaggttactggggtacaggtggtatttggctacacgagtaagttcttcagtggtgatttgcaagattttggtgcacccatcacccgagcagtatacactgcaccctatttgtagttttttaataacttcaagattgaaaacatggaagttactgagtacccaaaaaaccccttagccattagcagatcctgcatttccccgtcttctttttgtctctgtggatttgcctattctggatatttcattaaatggaatcatacaa

SEQ ID NO: 122017 - DNA, 1809 bp, Homo sapiens
  Payload ID: 3919
  Gene Symbol: COG3
  Gene Name: component of oligomeric golgi complex 3
  Uniprot ID: Q96JB2
  ENST ID: ENST00000617493
  CDS Start-End: 33-1367
cgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaggtgcttgaagatcatgtgcagaacaatggtaaatgagtagaaatgatcattttaagttatatcactggctcaatgaatttgaaaaaaaaataagtgcttcttccctcaccccactaaatagataaatttaatatttttgaagcttggcttgatgccttaccccttcttgaatgaagttgcaccttattctgtcactaaagacacaatcagatagggaaagaatcttaaaatctgggtaaaattagtaataaaataattatagtcagttttctttctggcatctggaatccagatagaacacatcgttacttttgggttaggcatttctagcacactgttaccagaatacaaaatacataaataaataattgaatatattgtatacttttgattaaaaaacaggaattgttttgtgtatattcataataatagttgatctgttttgaaattacaaataaagaaaagcggttctctggaa

SEQ ID NO: 122018 - DNA, 255 bp, Homo sapiens
  Payload ID: 3919
  Gene Symbol: COG3
  Gene Name: component of oligomeric golgi complex 3
  ENST ID: ENST00000476702
  CDS Start-End: 1-255
cctgaggcggcggcggagcgggacgctagggaaaagctggctctctgggatcggagaccggacacgacggcgccgctgaccgacaggcagacggactcggtattggagctgaaggcggcggcagagaacttgccggtgccagctgaggatatggtaccggaagtggatctgaaatcaatgaaggcgcaggtggaaatttctttggctcagctatcaaactcttttataccctggataataaaagttgtttgctct

SEQ ID NO: 122019 - DNA, 2833 bp, Homo sapiens
  Payload ID: 3920
  Gene Symbol: COG4
  Gene Name: component of oligomeric golgi complex 4
  ENST ID: ENST00000323786
  CDS Start-End: 23-2392
ctcgcgggaccggaagtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagaga

SEQ ID NO: 122020 - DNA, 2756 bp, Homo sapiens
  Payload ID: 3920
  Gene Symbol: COG4
  Gene Name: component of oligomeric golgi complex 4
  ENST ID: ENST00000393612
  CDS Start-End: 12-2318
ggaagtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctgagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggag

SEQ ID NO: 122021 - DNA, 2953 bp, Homo sapiens
  Payload ID: 3920
  Gene Symbol: COG4
  Gene Name: component of oligomeric golgi complex 4
  Uniprot ID: Q9H9E3
  ENST ID: ENST00000482252
  CDS Start-End: 1-1014
atggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagaactttgttttttccttcttttgagcagagaaagtaaaagtacgacatagaaataggagtggcctcatacaattgtatttctagaactccagactaggagactataaacagtagtctattggaacaccattagcatgacttttaagcacagtaatagagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttgg

SEQ ID NO: 122022 - DNA, 554 bp, Homo sapiens
  Payload ID: 3920
  Gene Symbol: COG4
  Gene Name: component of oligomeric golgi complex 4
  ENST ID: ENST00000530160
  CDS Start-End: 12-314
ggaagtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtgg

SEQ ID NO: 122023 - DNA, 590 bp, Homo sapiens
  Payload ID: 3920
  Gene Symbol: COG4
  Gene Name: component of oligomeric golgi complex 4
  ENST ID: ENST00000564653
  CDS Start-End: 8-589
gtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtgatctgccccaggtggagcgcttcttcaagatcttcccactgctgggtttgcatgaggagggattaag

SEQ ID NO: 122024 - DNA, 575 bp, Homo sapiens
  Payload ID: 3920
  Gene Symbol: COG4
  Gene Name: component of oligomeric golgi complex 4
  ENST ID: ENST00000565715
  CDS Start-End: 1-432
gccatcaagccacaggtgcagccttggatcaacagctttttctccgtctcccacaacatcgaggaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaag

SEQ ID NO: 122025 - DNA, 3000 bp, Homo sapiens
  Payload ID: 3920
  Gene Symbol: COG4
  Gene Name: component of oligomeric golgi complex 4
  ENST ID: ENST00000564415
  CDS Start-End: 16-408
gaccggaagtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaacactcaacaaatttggaatagaggggaacttctcagcctgataaagagcatctgtgaaaaaccacagctggccaggtgtggtggctcatgcctgcaatcctaacactttgggagaccaaagcagtaggatctcttgaggccagaagttggagaccaaaccttggaacacaaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagagat

SEQ ID NO: 122026 - DNA, 647 bp, Homo sapiens
  Payload ID: 3920
  Gene Symbol: COG4
  Gene Name: component of oligomeric golgi complex 4
  ENST ID: ENST00000534772
  CDS Start-End: 175-647
tgtcggacgcgccgagcttgtcttccctgatacctgggcgatctgcagcctctcctccctagacccccgttgatttccctgatccatgatcaccagtttctccacgggagtaaaaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggaggg

SEQ ID NO: 122027 - DNA, 550 bp, Homo sapiens
  Payload ID: 3920
  Gene Symbol: COG4
  Gene Name: component of oligomeric golgi complex 4
  ENST ID: ENST00000524584
  CDS Start-End: 1-218
attcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaatcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagcc

SEQ ID NO: 122028 - DNA, 4060 bp, Homo sapiens
  Payload ID: 3921
  Gene Symbol: COG5
  Gene Name: component of oligomeric golgi complex 5
  Uniprot ID: Q9UP83
  ENST ID: ENST00000297135
  CDS Start-End: 526-3108
attggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcattctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaacattgtttttaatttttaaaatcctatcagcagcctcctaattagcagtgttaggaatttgccttatgttttccatctcatctcctgaacctgttattctgagaactcataaataaaattcagcc

SEQ ID NO: 122029 - DNA, 4532 bp, Homo sapiens
  Payload ID: 3921
  Gene Symbol: COG5
  Gene Name: component of oligomeric golgi complex 5
  Uniprot ID: Q9UP83
  ENST ID: ENST00000347053
  CDS Start-End: 52-2571
gcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcattctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaacattgtttttaatttttaaaatcctatcagcagcctcctaattagcagtgttaggaatttgccttatgttttccatctcatctcctgaacctgttattctgagaactcataaataaaattcagccaagattaatcaatcaatcaatcaatcagtagacgtcagagataagcaacttttttttccatttatttgaaataatatacaagaatatagtgtgcaaaatttaggggcaacatcatgaagaagtgtgatgaactgaaatcaattttacagctgtgattcctaaccagaaacaccacttggtaagtaacatgaaaagccatgattgtagctcagagcaaaagcagctgtattgccaatgtatttgctctaattttagacagttggaggaaaattaaagtgcaagtgttgcactgcagtaagtgcaaagtctgcccccaccataaagattatgatgacaaaatatatttaagatacatggctgaggagatacagaacacgaagttaaaaaatacaatggtgttgactgtttgttaatagcaccattacagtgactatatcccaatgctattaactaactttaccttggcctgggctaggtctccattggaaataataacggatggctgctgccacctggtgcatcaactcagcatgccatggtaactgcagcaggtggctcttaggctgggacaccaacaccagccacctgccccatgttctggtagcctcttggcactgaccagactaggagcgcctatgtttggcacagatgctgagccatgtggtggttactagaggaaaggccgactcccagcttctgcttcatttcatcatgtgtacaatacagattaataagcagtaaggagccaatgtataaacagcagttacatattttttaaattcccctttcgtacaatttaaaataaaacatgtatacacttctcctctctttctactgtactttagcaccacaggatatcaattttcaagcctattattacctgatagacatatatgaagtttggaagaaaaataaggcaatttggtttaaaatgttgatagttttagcttaatgctctaatggagaaagcaaatcctcactcatattattaaatcatttcaagactcaa

SEQ ID NO: 122030 - DNA, 5418 bp, Homo sapiens
  Payload ID: 3921
  Gene Symbol: COG5
  Gene Name: component of oligomeric golgi complex 5
  Uniprot ID: Q9UP83
  ENST ID: ENST00000393603
  CDS Start-End: 273-2744
ggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcattctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggtaaagccaggtgctctgggggcacccatctggtctggaagcccaaggagggtggggatgcaagagaggatgaaggagcagtgcctgggggcatggacatgtgactgcaccttccagtggcgggccacctcactgcctaggcacgggtgctggagcaaccagcagttggaaatgttggccacaacatcttttgctttctttcattccaaaccttcatatccctgatgtgcaatcctgtgtcccatgcaaccctaaggaccatgcatttgtacctttgaaaatcatcatttgctatgaaaagttttgccctagctccgcatcttttacttcatttttatgtgctgcagttactgaattggtggaacacagatgtgagtgaatttttaaaaatacccaagtgcgaaacagttctgaggaggaaacaagaacaacccagcagccacttggataccatggccctccagtagtgccccatgaatgcattcacatacatacgcatgtgctcttgcccacacgtgcacacacccccatgtaccccaaccatgcccagggtggggtgctttaactgtcatacatggcttattaagcaacactcttccctgcaactgctctcaccatcaccagagacctctcagccaccaaacattcccatttttaccttaccactctgtagctttagctacagttgaccgccatttccttctgtaaactcataaactgggactcagcacatttttattgatgctgagctcacattttatcagcatggtaggccctgggccaggaaccgaggatacgaagtaagccgagatatggccctgtcctctcagagcttgcattacaccacagccatctgtttctgttctaacttctctggccatttttttttgtgtgtcatttgctgaattatcttcttctagccattccttaaatgctatcatttcccatattttcttcttctcatcctgcctctgccttggttcccaggtgagcttgtccagacccatgcctctagtgccccttctatacttaagagccctcaggtctgtgactgcctctggatggggccttggcccagtaaacttgctatcatatgtcaccacccacagaaatctcaaccccagaatggtcaaaataattctaatcttttctctcaaaccttctcattctcttatactccctgtcttggttgggaggtcacaatcacctaactagccaagccggaaaacctttacatcatcattcaactcctctgtcatccttattcctcaaacccactctgttgcgtctctaaaatagctcttgaagtcattctcaactctcccaggggatcccaattctgttggtctgggcccactgcacccagtgatcctttgttagcctgtgtcaggtgatgagttgagttccctaaagccagagtggggctgacatgatgaggtggttctaaaccacatgtgcacacaagaatcatttacatagcttggaaaattcctagtgcccaggtctctcacccttgcctacctcagaatctccagggtaggcctgctatcaggatttctctatagctccccaagaaggtccagggtgcagccaagggcgtgaacccctgccatagtgggtcatatttcagttaggatgaaagactgctgaggaagctatgacaggtcagtaagaaccatcagcctgtcagctttgtttccagaagtgaccctgagccctcaagcttggtacccacatcccacatgagccactggccctctgggcgtatgtgtggataaagattagctcggaccctgctctttttccttgcttatctgttactcagctatgaacatctgacacagaaatgggagaggttaccagccccggtgaatgttcctggtaaaatctgccctcgggaaaggctttggatttgggtgaggagtttgggcctgggctaacacagggatttgcaatgtctgtgtggattatttttcccgagtcccaaagattcactcagctgcaacacactcagtcgtcttaaaaagaggattcagttaattgaacacgttcatttttctcatcttaacaagttggtcatttttgtcgtcttaacaagttggaatgagttcatccaaaacagttgtcctgctgtgtgtacatcacaaatctgttttcttttgcttctctttaaaaatgtctcctgagtgatttcatcagcagtgctgttgctaagcctatatttagcaactgaaaatcatgctcagaaatactgtcatgcttttttaaaaaggcatatccatccctccacacatggctgattccagaaccttcatgcccttagcaaaaaattgagctgtccttcagggtttcaaaaaaagtactgtactcctgctgcaccccaggctcttggcaaggaggggacttttgtcctagagaatgttctttcttatgtattattgcaaaacaattttgttcttgcatactgaagcatcactggatgaatttctttcccctgtagacaaaccgagggtgagtattgctctttaaatgtcagtaaatttgttttagcttctggggcaaaccttgttgtatactcattctgttcctcccagcataatatgttaggttgtcataaaatagggcaaattgaggatagtgtaactactgctgctgaataaatgggaaatagtgaacca

SEQ ID NO: 122031 - DNA, 576 bp, Homo sapiens
  Payload ID: 3921
  Gene Symbol: COG5
  Gene Name: component of oligomeric golgi complex 5
  ENST ID: ENST00000605888
  CDS Start-End: 39-576
gttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttg

SEQ ID NO: 122032 - DNA, 3449 bp, Homo sapiens
  Payload ID: 3922
  Gene Symbol: COG6
  Gene Name: component of oligomeric golgi complex 6
  Uniprot ID: Q9Y2V7
  ENST ID: ENST00000356576
  CDS Start-End: 4-231
gctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggaattaggaatcctgctgttaagtttctcatggttgttatttgaggactcagtgagagactccaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagctt

SEQ ID NO: 122033 - DNA, 3563 bp, Homo sapiens
  Payload ID: 3922
  Gene Symbol: COG6
  Gene Name: component of oligomeric golgi complex 6
  Uniprot ID: Q9Y2V7
  ENST ID: ENST00000455146
  CDS Start-End: 51-2024
gtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaattgtatataatttatttctacagagaaagaagattgataccttgctatgagtgaattcctttgttttatagggaaaatttattgtgctttttacctggttttttcaaataaaatattaaaatatttcta

SEQ ID NO: 122034 - DNA, 5257 bp, Homo sapiens
  Payload ID: 3922
  Gene Symbol: COG6
  Gene Name: component of oligomeric golgi complex 6
  Uniprot ID: Q9Y2V7
  ENST ID: ENST00000416691
  CDS Start-End: 101-1948
gatgcgcatgcgcggccgatttgcacatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaagcgtccacccaacggcccatgatcatcttgtaaccagtgcaggaccttgtgcttctggagccattccagttgtgggaggtgatgtctcggaaaactctgccttggggactggctatagaaatgtggccagatggctttgtcatcttcccctgtctactctgtgactcttcatctggtggaaatgctgtgagggatgaaccaaatggaaactcagatttactcttcagaataatgcggatcataatacgcacacacacagcatgtagagttgctgtgtggcttaaataagtaaatgtatgcaaagcactaaaatggtgtctgtctaagtgtaaacaccaattgtgttggctattatcactattgttgttcttatctcaaatatgtgttactttctaaataactttagtgttcatagattgttaaaagacaagatgacctgaagaaaagtaagccctaaaaatccattattaacttttttctccaccactcttttcttctaaacttcactattctttgtgttttcacaaaagttgcttacttcacctggcagagatagcattacgcaggggatgattaaaatatactcacttgtacttgttggttttaaattttattatttatgaataggtaatagcatgtacactgtaaaaatctcaaaaggcaaaaaaggatatacagtaaacattaagttcctcttaccctggaccttagccatcaagttctcttccccataggcaatccctgttgcctaatttccaattcccctgcatactttaaagatcatctgtgcatctgcactcagaccactcacacgtctaaaacaaatgatagcacactacacacaaagttctgttcctttttatgctcaatgatatgttttgcatcatatttcactgccgtataaataatgctgcctcgatttttaaaataactgaacagtaatacacagtatgaatttactccaatttataatccaatccttagttaatggatattttgattttgttgttaagaatcatgcagcaatgatgtacctgttagacatgagttattaatttctcttcgaagaatcaatatgtcactacgttcaattctttgccttctacttttaaacttcacttcctcataaagcaaccttttgcgatcatctgctccaccctgactcattccaatcacctgctccaccctgactcattctgatcacctgctctgcccagactcattcccatcacctgctccaccctgacttattccaattacctgctccaccctgtctcattctccaccctgactcattccataaccatttttcccaccaaaccagtcaccccctcaccctctttaaattagctaatcggaattagtttagcttgtgtggtctaacctagccaatagatgaatgacacagcagcaggagccacgttcgtcagggataagaacaccttccccttccttgtccaggggtgtactcaccattgctccatctgtgagggcgcacccttctatagaagtaaattgccttgctgagaagaaaaaaagaaaattttatatttgagtgctatttattttgtggcaccaaaactatttataacatacctgatctttattttaaatttttgtttatttaaatattaaatatattatccacctggtattaatttgtttaaataaatgtgaggtagggttccattgctattttttaaccaggtaggttatattgactaaccttcactttgaaagtgatttgaaatacacttttcatttattaaattctcccttgtgtttaggcagtaaggcataatatttgagagtgtgggctctgcagtccagctatctgggtttgaagtttatctcctttatttgcgagtggtacaaacttgaacaaattatgtaatttgtttttctcaattccctcatgcactaagtgaggataaaaatagcaataacaccatgagattgctgataacaaaatgcaaggtaaaaattgtgtaaggcttaaaattgtgtagcctggtatacaagaggctctaaataacataagctattattgcttttctacttattattatttctggcttttgtagtctttttcccattgttgatctttctactattcacaaagcatgagtctagtatctgtagatttataaactaattaatgtaacttttcaatatgttttaatatctcatagatactgttcttcctcattacttttctattttataaatttctatttcatctgcttcataaattttgcattctcataaactaagaatcatctcctgtagttaaaaaatattgtttgtatttttgttgggagtagagtgaattaaaatatattgacttaaggagaactgacatctttataatattgaatcttcctgtttgagattggactttatgtccatattttaaagtctttgtttatgaccctaagtataattttaacgtttttatattaggcttatttctagatactttttgttaatatatcatctaactggttgttcttcatatatataatgactatgaattttttctcagtcttttttctgaattctcacatcatttgtgttatatttttaagttgattctcttgagtttttcaggtaaacaattatatcacctataaaaataatgttgccaccttaaattaagaaaatgtttttctattgtctaattgcatggactgttgcctcaggaacagtataagattgcttacaaaagccttgctttcttgttccagattttaaaaacaaggctttcaatgacaatctcgctagcaagaagctggtatacttacatacatacatacaaacagacagacacccactttctatatgtatatctagatagatttagatagacatatatgtgtgattcctgttaagatgaatctatttttggtatttaagattttaaaaatctagaatgggtattattatattgtattgaagctcttaagcatctatggaaatgaaagtatgattcttctctttcgactaattaatatgtgatccatagtattttagtaacagatttcctaatatcgaatgatctaggcattgattctagcagattatgtctatgggtattttatttaagattttgcatcagtattaataaatgaccatggtctatgggtttgcttttttgtgtgctatgtttgcagagtgtttgtagtttacaagagatttttgcaaacttctatttatgacaatatggtagattatatatctgaaaaaaaaaccttctcattacagaacatatacaaaactgctgaataaaacgaggcaaccaacattttaaatatatggttaataaggtttt

SEQ ID NO: 122035 - DNA, 546 bp, Homo sapiens
  Payload ID: 3922
  Gene Symbol: COG6
  Gene Name: component of oligomeric golgi complex 6
  ENST ID: ENST00000543790
  CDS Start-End: 66-251
actcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggtgccttcaaggctctctggatgggattggtgaacggtggtgcctcgagaagtgtcctccaaacacccctggaggcgtttggctgtgtgagctgggagagtggaggagagcacaagactggatatgaaacagatgcaaaagagcagattccaagataaggaattaggaatcctgctgttaagtttctcatggttgttatttgaggactcagtgagagactccaggagatgttagaagctctcaaggcactttcaaccttttttgttgaaaatagtctgcggactcgaagaaatttacgtggagatattgaacgtaaaagtttagccat

SEQ ID NO: 122036 - DNA, 553 bp, Homo sapiens
  Payload ID: 3922
  Gene Symbol: COG6
  Gene Name: component of oligomeric golgi complex 6
  ENST ID: ENST00000543804
  CDS Start-End: 66-254
actcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactg

SEQ ID NO: 122037 - DNA, 528 bp, Homo sapiens
  Payload ID: 3922
  Gene Symbol: COG6
  Gene Name: component of oligomeric golgi complex 6
  ENST ID: ENST00000542266
  CDS Start-End: 77-262
acatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggtgccttcaaggctctctggatgggattggtgaacggtggtgcctcgagaagtgtcctccaaacacccctggaggcgtttggctgtgtgagctgggagagtggaggagagcacaagactggatatgaaacagatgcaaaagagcagattccaagataaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaa

SEQ ID NO: 122038 - DNA, 564 bp, Homo sapiens
  Payload ID: 3922
  Gene Symbol: COG6
  Gene Name: component of oligomeric golgi complex 6
  ENST ID: ENST00000536488
  CDS Start-End: 1-403
cttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgagtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttg

SEQ ID NO: 122039 - DNA, 186 bp, Homo sapiens
  Payload ID: 3922
  Gene Symbol: COG6
  Gene Name: component of oligomeric golgi complex 6
  ENST ID: ENST00000630730
  CDS Start-End: 1-186
atggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggtgccttcaaggctctctggatgggattggtga

SEQ ID NO: 122040 - DNA, 2926 bp, Homo sapiens
  Payload ID: 3923
  Gene Symbol: COG7
  Gene Name: component of oligomeric golgi complex 7
  Uniprot ID: P83436
  ENST ID: ENST00000307149
  CDS Start-End: 187-2499
tcccagccgcaaactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggaggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagaccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaa

SEQ ID NO: 122041 - DNA, 814 bp, Homo sapiens
  Payload ID: 3923
  Gene Symbol: COG7
  Gene Name: component of oligomeric golgi complex 7
  ENST ID: ENST00000561854
  CDS Start-End: 1-265
gaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcggttctccaggccctgccccagagattctgacttagcaagaccgggctgaagctcagacatctatgttttcgaagaggacttgagaaccgttgaggggagcttcagtgagataagattcagcgagtcctgcagcctggccccacctggcccgctccatttgtgccataattcccaaccagtgtttaatgagctcttactgcataccaggcatgcctggcgctggaccaagcactcgcacccatcgtcttatgtaattccaaactcccctgtgagactatctgatcaacgtgatggatgccctgggcctgcagccgtcccgcaccctccagcacatcgtgacgctactgaagaccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcct

SEQ ID NO: 122042 - DNA, 741 bp, Homo sapiens
  Payload ID: 3923
  Gene Symbol: COG7
  Gene Name: component of oligomeric golgi complex 7
  ENST ID: ENST00000563164
  CDS Start-End: 1-341
aggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcggtgggtccccacaagacaggcggtgggagggacagctcttgcctgctgcatctgtcagtttctcctttgccctccaggaatctcatcccaagtcttcccttagcttcagctgtggatttggctctgaagctggttgaaaattcaggttctccaggccctgccccagagattctgacttagcaagaccgggctgaagctcagacatctatgttttcgaagaggacttgagaaccgttgaggggagcttcagtgagataagattcagcgagtcctgcagcctggccccacctggcccgctccatttgtgccataattcccaaccagtgtttaatgagctcttactgcataccaggcatgcctggcgctggaccaagcactcgcacccatcgtcttatgtaattccaaactcccctgtgaggtgggtgctctcttctccatcataccgatagggaacggaggcccagggcagttccataacaaggccatgtggccagggtcactttgtggtctccatccagatagcatcctgcctgccaa

SEQ ID NO: 122043 - DNA, 4247 bp, Homo sapiens
  Payload ID: 3924
  Gene Symbol: COG8
  Gene Name: component of oligomeric golgi complex 8
  Uniprot ID: Q96MW5
  ENST ID: ENST00000306875
  CDS Start-End: 116-1954
aagccggccggatgagaaagcatagagaccggaaatgtgcctgtttcttcctgtcctaagttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcgggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggccatttgtgccgagttcttatttttacggagggcttgtggccttagacgccagtttgcttatggaaatgaaagagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccaggtgcagtggttcacgcctgtaatcccagcactttgggagggcggggcgggtggatcacgaggtcaggagctcaagaccagcctggccaagatggtgaaaccctgtctctactaaagatacaaaaattagccgggcgtggtggcgagcacctgtaatcccagctactcgtgaagccaaggcagagaattacttgaacccaggaggcggaggttacagtgagctgagatcacgccactgcactccatccagcctgggcgacagagcgagactcaaaagtatgattctggctgtagagttttctttttttctctgtctcaaaaaaaaaaagtgtcagctttgtcttgtcaagaggtgaaggaacttgttttattcttttattttttttttaagatagagacgggggtcttactatgttgcccaggctggcctcaaattcctggtctcaggcaatcctcctgcctcggcctcccaaagtgctgggatcagttgtgagccacactacccagccaaactccagttttagttaaactgtttcacctcatttttatgctgagttttgtaaagtaggtattcttgctgaacagagtcctgaaaatcaaactatacaagtagtaggaagtccattaagctgtttagaggaaaaagtgttataaatggcagttaaatgaacccaggaaagacccatcctcctttgtggctttctctgaggccccatgaggccaagcagaagcaaactggctctaggtgcagccagactttgaaaaggaatcccggccaggcttggtggctcatgcctgtaatcccagcactttgggaggtcaaggcaggcagatcacctgaggtcaggagttcaagaccagcctggccaacatggcgaaacactgtttctactaaaaatatgaaaattagctgggtgtgctggtaggcgcctgtaatcacagctacttgggaggctgaggcgggagaatcgctcaaacctgggaggcagaggttgcagtgggctgagatctcgccactgtactccagcctgggcgacagaccaaggctctgtctcaaaaaaaaaaaaaaaaaaaaaaaaagggaatcccaaccagatactggtgcaaggtcagagatgcagccaatggggagatttgtagaaagctcatagatgctaaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggtagcaataaaatgcaaactttattgca

SEQ ID NO: 122044 - DNA, 1731 bp, Homo sapiens
  Payload ID: 3924
  Gene Symbol: COG8
  Gene Name: component of oligomeric golgi complex 8
  ENST ID: ENST00000562081
  CDS Start-End: 32-1636
ccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggtaagagaatgaaaattctgtaaactgccttactgatgtgtaattcacatactaaataattcatccatttgtgtaagtcagtgttttttagtaaatatgaatccaattttagaatatt

SEQ ID NO: 122045 - DNA, 2262 bp, Homo sapiens
  Payload ID: 3924
  Gene Symbol: COG8
  Gene Name: component of oligomeric golgi complex 8
  ENST ID: ENST00000562595
  CDS Start-End: 1-670
ggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccatgctgggattacaggcgggagccacggcgcccggccaggagccttcttagctgcacacccccaacaccagccacaagggcagacccttgccaggatggcacgggccaggctatgcaggtgaggcgctgcctttgcaactgcgtcacagtcttgacacattcactgcctcactgcaccgcaaagccaaacccatggattgacgtcatattatctggacctgactttacttgctaaagaatataaaatgcaggctaggtgtggtggctcagctcatgcttgtaatcccagcactttgggaggccacgctgagaggatcacttgagcccagcagtttcagactggcctgggcaacactgtgaggccgtttctaaaaaaaaaaggaaaaattagctgggcatgatggtgtgtgcctgttgctactcaggaggctgaggtcagaagattgtgtgagctcgtgaggtcaagcctgcagtgagctatcactgcaccactgcatctagcctttctctgtatgtacaaaatgctaatgctgccacctgcattctgggcccccagtgagtgtaatgccagcttccctgagctacaaaggccattctcaacagcccaggacatagaagaagactattttttatttttgagacggagtctcactctgtcacccaggctggagtgcagtggcccaatctctgctcactgcaacctctgcctcccggcttcaagcgatccttctgcctcagcctcctgagtagctgggactacaagtgcacaccaccacacccggctaatttttgtatttttagtagagacagggtttctccatattggctaggctggtctcgaactcctaaccttgtgatctgcccaccctggcctcccaaagtgctgggattacaggcgtgagctaccatgcctggcctggagaagaccgtttttattctggacccaaaccctcaattttctgggctctgtgcagccctcttccctcccctgtcaagtcacttaccatgcaaaccacaggctctaagagtttgtccccagggacatccatccaagtcatctccatggctcctgggtcccctggtgagcatggagtcaggaggtcatcaatcatcatgctggggttggtgcgagaggggccacagacctgaaaccaaatggatctgactggggcagctgcccctcagtgtcagaggggctcgacccctccggtctctaaggaagtcccaaagagaatgctctgtgggtccctagcatctgaggaggacgggctccttcagaactcgggctgggtggtccgagcgactcatgatttgcatgggactctggcaatctgtagccccaatgccttgatgtcttcctcattaacactgtcacgtctcaccaggaatacagtgacattaaaagtgtgatatggtttagctgtgcccccacccacatttcaacttgaactgtatctatctcccagaattcccacatgttgtgggagggacccagggggaggtaactgaatcatgggggctggtctttcccgtgctattctcgtgatggtgaagtctcacgagatctgatgggtttatcaggggtttccacttttgtttcttcattttctcttgccaccagcatgtaagaagtgcctttggtctcctaccatgattctgaggcctccctagccatgtggaactgtaaggccaattaaacctctttttcttccca

SEQ ID NO: 122046 - DNA, 712 bp, Homo sapiens
  Payload ID: 3924
  Gene Symbol: COG8
  Gene Name: component of oligomeric golgi complex 8
  ENST ID: ENST00000567493
  CDS Start-End: 414-712
cacaaagaaaaaggattcatgcaaagctcttattatcgggtctgacacagttaacattataggtgtgagctgaatatatgtgcacatttatatacttattttatacgaaagcgtggaccggaggtcatctgcttcaaaacttccattgacgggaaggtgacaaggaaatcctcgcatttgagggcatcagatatcaaaaagtctctccatttggatggctggatgtggtggctcagcctgtaatcccagcactttgggagcctgaggcttgaacccaggagttcgagagcagcctggccaacatggcaaaaccctgtctctataaaataaaaaattagctggtcgtggtggcgtgcgcctgtagtcccaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactga

SEQ ID NO: 122047 - DNA, 426 bp, Homo sapiens
  Payload ID: 3924
  Gene Symbol: COG8
  Gene Name: component of oligomeric golgi complex 8
  ENST ID: ENST00000615447
  CDS Start-End: 1-365
cggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggtgcgacgcgcctggcgctaaaggggttttataactgtaaaagctgacatttacgatggtagaaataactaacacataaagcgtttaccacgttc

SEQ ID NO: 122048 - DNA, 4470 bp, Homo sapiens
  Payload ID: 3925
  Gene Symbol: CRX
  Gene Name: cone-rod homeobox
  Uniprot ID: O43186
  ENST ID: ENST00000221996
  CDS Start-End: 208-1107
cccaccttggccgggattaccctccgagttccaggccatgacaaatgacatcactcccggcccaggcttaaaatctccccatgtgaggggatgtgtttccttcagcctctgctgtctggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagatgcccaccaccaggcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtgtatttggtagggaaatgaaaggcaccttgcctgttccatctctactccttttttcttttgttttaggattttctaaaggtgagacactggtggaactggggtagctgcttgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaaagtagggcaggaagacagtggtgtgctggcagaggtctaacaatgggctctccaaggaagaggaaaaggttggttgtggagtgtttgtcagtttccgtggtgtaaatactcccaccacggctgacttcaagctagcaaccggaggtcactgaactaagagttgggaagagatagggcacaatatatgcttacgagttggtacacaccgtcagcagcagccagggtcaggagaaaggcgagatgtgaagagaggccgggaggtatcagatgacgtttccagcactagaccagaagaggtgcacacagcctagaccccctgaggggtacaccctgatctctagagcccacaaagaggtttttattcaacataaaacgtgttcatctctcataggcctgagtcatgctgggttctgggacattaagcccaggagtgggccgggtgcggtggctcacgcctgtaatcccagcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaaa

SEQ ID NO: 122049 - DNA, 2275 bp, Homo sapiens
  Payload ID: 3925
  Gene Symbol: CRX
  Gene Name: cone-rod homeobox
  Uniprot ID: O43186
  ENST ID: ENST00000539067
  CDS Start-End: 140-1039
taaaatctccccatgtgaggggatgtgtttccttcagcctctgctgtctggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctc

SEQ ID NO: 122050 - DNA, 433 bp, Homo sapiens
  Payload ID: 3925
  Gene Symbol: CRX
  Gene Name: cone-rod homeobox
  ENST ID: ENST00000566686
  CDS Start-End: 262-433
aagagttgctgacaccttctctgtcccgctggaagttattttctcctccctctccctgtacagctgaccttccttccctgctgcagggccagggggtctgttccaggactggattctcccatcaggagcctctggactggtcgccgagggtcagacggcccctccctctcttgctgtcatccctggctcttcaagctaatgagacctgtcctgattcctcagccaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgt

SEQ ID NO: 122051 - DNA, 4193 bp, Homo sapiens
  Payload ID: 3925
  Gene Symbol: CRX
  Gene Name: cone-rod homeobox
  ENST ID: ENST00000613299
  CDS Start-End: 83-208
tgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagatgcccaccaccaggcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtgtatttggtagggaaatgaaaggcaccttgcctgttccatctctactccttttttcttttgttttaggattttctaaaggtgagacactggtggaactggggtagctgcttgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaaagtagggcaggaagacagtggtgtgctggcagaggtctaacaatgggctctccaaggaagaggaaaaggttggttgtggagtgtttgtcagtttccgtggtgtaaatactcccaccacggctgacttcaagctagcaaccggaggtcactgaactaagagttgggaagagatagggcacaatatatgcttacgagttggtacacaccgtcagcagcagccagggtcaggagaaaggcgagatgtgaagagaggccgggaggtatcagatgacgtttccagcactagaccagaagaggtgcacacagcctagaccccctgaggggtacaccctgatctctagagcccacaaagaggtttttattcaacataaaacgtgttcatctctcataggcctgagtcatgctgggttctgggacattaagcccaggagtgggccgggtgcggtggctcacgcctgtaatcccagcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaaa

SEQ ID NO: 122052 - DNA, 2339 bp, Homo sapiens
  Payload ID: 3926
  Gene Symbol: CTGF
  Gene Name: connective tissue growth factor
  Uniprot ID: P29279
  ENST ID: ENST00000367976
  CDS Start-End: 202-1251
cacacaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccatgcgacccgcacaagggcctattctgtcacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 122053 - DNA, 2625 bp, Homo sapiens
  Payload ID: 3927
  Gene Symbol: CNKSR1
  Gene Name: connector enhancer of kinase suppressor of Ras 1
  Uniprot ID: Q969H4
  ENST ID: ENST00000361530
  CDS Start-End: 146-2287
atcttgccgtctgtgtgagcccaggtatgcagtaggctccgcccaggacccagcccggcccctccttaggcctgggctctgggagcggaaattccggcgacagcagggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaatg

SEQ ID NO: 122054 - DNA, 2538 bp, Homo sapiens
  Payload ID: 3927
  Gene Symbol: CNKSR1
  Gene Name: connector enhancer of kinase suppressor of Ras 1
  Uniprot ID: Q969H4
  ENST ID: ENST00000374253
  CDS Start-End: 40-2202
ggcaaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgcgtgaggagagggacatggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaa

SEQ ID NO: 122055 - DNA, 2673 bp, Homo sapiens
  Payload ID: 3927
  Gene Symbol: CNKSR1
  Gene Name: connector enhancer of kinase suppressor of Ras 1
  ENST ID: ENST00000531191
  CDS Start-End: 1008-2375
ttctgattcagcaggtgtggggtgaggcctgataatttgcatttctaacaagttctccggtgagtctgctgctgctggtctgggggccacttttaagaacccatgtcctatactttcctgcttctcaactcagtggcctcatctgtgaaatgggcagaacagcctgggtgtcagagttgtcattagggttagactagagggaaaagagctttgcaggcatgaagaaccatcccaaaaggtcctgacacctctgcttccccgagctgagccttactctccctccaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagg

SEQ ID NO: 122056 - DNA, 865 bp, Homo sapiens
  Payload ID: 3927
  Gene Symbol: CNKSR1
  Gene Name: connector enhancer of kinase suppressor of Ras 1
  ENST ID: ENST00000481077
  CDS Start-End: 65-256
ggagcggaaattccggcgacagcagggcaaaacaggagctgattcgagctggcagagctgggccatggaaccggtagagacctggacccccggaaaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgc

SEQ ID NO: 122057 - DNA, 842 bp, Homo sapiens
  Payload ID: 3927
  Gene Symbol: CNKSR1
  Gene Name: connector enhancer of kinase suppressor of Ras 1
  ENST ID: ENST00000528281
  CDS Start-End: 1-236
aaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagac

SEQ ID NO: 122058 - DNA, 2507 bp, Homo sapiens
  Payload ID: 3927
  Gene Symbol: CNKSR1
  Gene Name: connector enhancer of kinase suppressor of Ras 1
  ENST ID: ENST00000482227
  CDS Start-End: 37-726
aaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatcccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaag

SEQ ID NO: 122059 - DNA, 1200 bp, Homo sapiens
  Payload ID: 3927
  Gene Symbol: CNKSR1
  Gene Name: connector enhancer of kinase suppressor of Ras 1
  ENST ID: ENST00000525687
  CDS Start-End: 37-975
aaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacaggtaacaggctctgtccaggtgtgtcttggtggggagaccgtgggctcatctcatcccccttgccctccccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcg

SEQ ID NO: 122060 - DNA, 4478 bp, Homo sapiens
  Payload ID: 3928
  Gene Symbol: CNKSR2
  Gene Name: connector enhancer of kinase suppressor of Ras 2
  Uniprot ID: Q8WXI2
  ENST ID: ENST00000279451
  CDS Start-End: 457-3153
gtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcc

SEQ ID NO: 122061 - DNA, 5315 bp, Homo sapiens
  Payload ID: 3928
  Gene Symbol: CNKSR2
  Gene Name: connector enhancer of kinase suppressor of Ras 2
  Uniprot ID: Q8WXI2
  ENST ID: ENST00000379510
  CDS Start-End: 37-3141
gagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaacaaaaaacctcttgtcctaaaatgaagtgtgcttgttaacaggtgtttagacttattgatgtttactagaccaaatgtgtatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatcctta

SEQ ID NO: 122062 - DNA, 5668 bp, Homo sapiens
  Payload ID: 3928
  Gene Symbol: CNKSR2
  Gene Name: connector enhancer of kinase suppressor of Ras 2
  Uniprot ID: Q8WXI2
  ENST ID: ENST00000425654
  CDS Start-End: 481-3495
gtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatgaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaacaaaaaacctcttgtcctaaaatgaagtgtgcttgttaacaggtgtttagacttattgatgtttactagaccaaatgtgtatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatcctt

SEQ ID NO: 122063 - DNA, 4355 bp, Homo sapiens
  Payload ID: 3928
  Gene Symbol: CNKSR2
  Gene Name: connector enhancer of kinase suppressor of Ras 2
  Uniprot ID: Q8WXI2
  ENST ID: ENST00000543067
  CDS Start-End: 481-3030
gtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtgcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcc

SEQ ID NO: 122064 - DNA, 3625 bp, Homo sapiens
  Payload ID: 3929
  Gene Symbol: CHUK
  Gene Name: conserved helix-loop-helix ubiquitous kinase
  Uniprot ID: O15111
  ENST ID: ENST00000370397
  CDS Start-End: 88-2325
cgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttagtagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaata

SEQ ID NO: 122065 - DNA, 645 bp, Homo sapiens
  Payload ID: 3930
  Gene Symbol: CNST
  Gene Name: consortin, connexin sorting protein
  ENST ID: ENST00000366511
  CDS Start-End: 202-615
ggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccagatagcagaatcctatttccaggaggaggactatgagaaagcaatgaaattcattcagctagaacg

SEQ ID NO: 122066 - DNA, 2422 bp, Homo sapiens
  Payload ID: 3930
  Gene Symbol: CNST
  Gene Name: consortin, connexin sorting protein
  Uniprot ID: Q6PJW8
  ENST ID: ENST00000366512
  CDS Start-End: 381-2231
cgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccggacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcagatagcagaatcctatttccaggaggaggactatgagaaagcaatgaaattcattcagctagaacgattgtatcatgagcaattgctcgcaaatctttctgccattcaagaacagtgggaaacaaaatggaaaactgtgcaaccacatacagttacggctctaaggaattcagaaaagggatttaatggtgaagattttgaacggcttacgaaaatttgtgcaacacatcaagatcctcttttatccaaacataagatagcagctgtggagaagtcccaggaaaggaaatgctccacgcagttactagtgtctgaagatccaaaggaaggaggagctaccaccaaagagtcagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatactac

SEQ ID NO: 122067 - DNA, 5126 bp, Homo sapiens
  Payload ID: 3930
  Gene Symbol: CNST
  Gene Name: consortin, connexin sorting protein
  Uniprot ID: Q6PJW8
  ENST ID: ENST00000366513
  CDS Start-End: 270-2447
tctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcagatagcagaatcctatttccaggaggaggactatgagaaagcaatgaaattcattcagctagaacgattgtatcatgagcaattgctcgcaaatctttctgccattcaagaacagtgggaaacaaaatggaaaactgtgcaaccacatacagttacggctctaaggaattcagaaaagggatttaatggtgaagattttgaacggcttacgaaaatttgtgcaacacatcaagatcctcttttatccaaacataagatagcagctgtggagaagtcccaggaaaggaaatgctccacgcagttactagtgtctgaagatccaaaggaaggaggagctaccaccaaagagtcagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggttgttcctactgaaggattggtctccatattaaagaagaggaatgatactgtaggagatcatcctgcccaaatgcaacacaaaccatctaagcgaagagtgagattccaagaaatagacgatagcttggatcaagatgaagttggaggtggctcctgtattttgctggtcttgctgtgcatagcaacggttttcctcagtgttggaggaactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatttcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtatttgcccataggcaaccagagccacttcctctgaacccaacatctcctggggaccttcgcagcaagaggaaagcactgagacaatagcttgctaagcaggggcccagtggtgtctcagagaaaccatgggtgtcctcgccacttcccagggagggtgaggtgagctcgggaacataacgatgttttgacttacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaacaaagtgtctcagagagtttatttgaaccattgggtgctgagaaaaaactgctttaaagtgaaactttgatttcagaagttgatctggccctacaagtagacagtcatctactttgggaagactaataggtccttaggtaacggctcttctgctttaaaatacctcccccatctgctgacagtagctgaagattattctaaacattcattcttttagatttaaaaataaaaatcttctggaggatt

SEQ ID NO: 122068 - DNA, 3328 bp, Homo sapiens
  Payload ID: 3931
  Gene Symbol: CNTN1
  Gene Name: contactin 1
  Uniprot ID: Q12860
  ENST ID: ENST00000348761
  CDS Start-End: 75-3098
gtttaaaattatccaactgccatagagctaaattcttttttggaaaattgaaccgaacttctactgaatacaagatgaaaatgtggttgctggtcagtcatcttgtgataatatctattactacctgtttagcagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaa

SEQ ID NO: 122069 - DNA, 5507 bp, Homo sapiens
  Payload ID: 3931
  Gene Symbol: CNTN1
  Gene Name: contactin 1
  Uniprot ID: Q12860
  ENST ID: ENST00000347616
  CDS Start-End: 80-3136
caggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccattatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttaccc

SEQ ID NO: 122070 - DNA, 5557 bp, Homo sapiens
  Payload ID: 3931
  Gene Symbol: CNTN1
  Gene Name: contactin 1
  Uniprot ID: Q12860
  ENST ID: ENST00000551295
  CDS Start-End: 118-3174
tccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccattatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttacccaagaaagaacaa

SEQ ID NO: 122071 - DNA, 463 bp, Homo sapiens
  Payload ID: 3931
  Gene Symbol: CNTN1
  Gene Name: contactin 1
  ENST ID: ENST00000552248
  CDS Start-End: 194-463
ctgaactgaatttacacgaaaagggaaggaggaaaatggtttgtctttttttgcagagaattctatccaaattcacttgcatttaattacttcatattttggaaatgacattttcaagtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcga

SEQ ID NO: 122072 - DNA, 553 bp, Homo sapiens
  Payload ID: 3931
  Gene Symbol: CNTN1
  Gene Name: contactin 1
  ENST ID: ENST00000548005
  CDS Start-End: 299-553
agctgaactgaatttacacgaaaagggaaggaggaaaatggtttgtctttttttgcagagaattctatccaaattcacttgcatttaattacttcatattttggaaatgacattttcaaccatgtgacaaatctgcagcccctttgccatgattaaaggtctcctgaggccctgaccagaagcaaacgctagtgccaggcttcttgtacagcccgcaaaactgtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgat

SEQ ID NO: 122073 - DNA, 3033 bp, Homo sapiens
  Payload ID: 3931
  Gene Symbol: CNTN1
  Gene Name: contactin 1
  Uniprot ID: Q12860
  ENST ID: ENST00000547702
  CDS Start-End: 228-2111
cttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagaca

SEQ ID NO: 122074 - DNA, 3125 bp, Homo sapiens
  Payload ID: 3931
  Gene Symbol: CNTN1
  Gene Name: contactin 1
  Uniprot ID: Q12860
  ENST ID: ENST00000547849
  CDS Start-End: 320-2203
gctttatttgaaagtattgctatgtagacagccggcttttctgtcatctaacctgctctccccaggttggctgaaggatgggagcggctgtgcctgcctgtgaggtcacagcatgaagtccttttaacttgctttctgctgcaggagagaggcgtattgtggtataactgttgctgtatttattcaaatggacaatttgcaatagatattatacccaggacgacagataagtcaacacataaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagaca

SEQ ID NO: 122075 - DNA, 512 bp, Homo sapiens
  Payload ID: 3931
  Gene Symbol: CNTN1
  Gene Name: contactin 1
  ENST ID: ENST00000548481
  CDS Start-End: 1-174
aaacactccatagaagtcccaatccccagagatggagaatacgttgtggaggttcgcgcgcacagtgatggaggagatggagtggtgtctcaagtcaaaatttcagaaggaaaatccacatccttgagaagtaaaacagccaaagatcacagaagcatcagaaccatgtcttgagcccaaatattctctgttgctaaagttatataactagctattgacagaactagaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggata

SEQ ID NO: 122076 - DNA, 572 bp, Homo sapiens
  Payload ID: 3931
  Gene Symbol: CNTN1
  Gene Name: contactin 1
  ENST ID: ENST00000552913
  CDS Start-End: 355-572
aacttgctttctgctgcaggagagaggcgtattgtggtataactgttgctgtatttattcaaatggacaatttgcaatagatattatacccaggacgacagataagtcaacacataagtagagacggggtttcaccgtgttagccaagatggtctcgatctcctgacttcgtgatccgcccgcctcgacctcccaaagtgctgggattacaggcgtgagccaccgtgcccggccgcttcaagatttcttaatgaaggtagttgcatcgatgttcataggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttccc

SEQ ID NO: 122077 - DNA, 555 bp, Homo sapiens
  Payload ID: 3931
  Gene Symbol: CNTN1
  Gene Name: contactin 1
  ENST ID: ENST00000551424
  CDS Start-End: 368-555
gggtgggctccgccgaggcgaggaggggcgccggtggggagatgcgctcccaggtgtttgcagcggaagtgggaaacctgtagggtatggtccagctgtgccgcaccgaggcgagcaggagcagggaacagtagagacggggtttcaccgtgttagccaagatggtctcgatctcctgacttcgtgatccgcccgcctcgacctcccaaagtgctgggattacaggcgtgagccaccgtgcccggccgcttcaagatttcttaatgaaggtagttgcatcgatgttcataggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcact

SEQ ID NO: 122078 - DNA, 8141 bp, Homo sapiens
  Payload ID: 3932
  Gene Symbol: CNTN2
  Gene Name: contactin 2 (axonal)
  Uniprot ID: Q02246
  ENST ID: ENST00000331830
  CDS Start-End: 285-3407
gctccgggcgcgctcacacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtcctcggaagctccgagcctgttttctgtagtttatagttagagctctattttgttatggttttttaaacttttaagtcctgctctattttcctgggcaggtttatgttgatgtttacccactacaattttttaaaaatataagctcacatgccttttccctgccacagccaaacccccactgcaccctacccacccacccctagcccaggtcagctttcctggagctggctaatgaaagcctcctcacctcttcccaacccttacaagcaagggtgctaggggctcagctatacgaccattctccctgacagggagtccaaacttggcctagcatccctcctggcccccctctggccacgacttggcctgtgcctggttctctatcagaaaggggatgctgaacaaaacctccttccaagttttatccaattcgttcctcattgcctcgggctgcgtcaggggaagcaggggacaggtgtccagttgctgggccgagggaggagctggtttggcataggacctaaccagtgaagctagaggctacagccactaaacttgcttcaggccaacgatagttactcacaagtaagtaccttaatgctaatgaggtccactaaaaaggggaggaaggcagacctcctgggagacccacgaagggtttttagccagggaaaactgagccccaggaaaacctaaccactgggcaggcagaatttgtttgagggatagaacgacaacaaaataaatgttcctgcagcctgagatttcaggtagagtactgactaaggtttaataagacaataggtgacctgaggacatgcaagcttgtaaaatgcaacagcctcctgctagagtgacttgtacatgagcttgcttgcagaagactagattagatgtttctcaggatcccctcctgcgcaggggttctctgattttcgtgttctctgcccagatgggctgggggagttgagagtgtgcttattttcactgcgatcatgagaccacagttctgggttatctcctctcatacatcaagccccagaggaggcggcaagaggaacagccacaaacaagtactttaccccacagcttagtggccagtaaacaccctggggactaggaaaaggaaccaactgtaggcacctctccagggcctagggagacaagtgtcctctcttctgcatacatttgggctccccttacagagccctttgccctggctctctggtccttgttgctctaacagtccagatgtacacccagcctcagggggaaggcagctctctccagacagagtctcagggcccagcaaggtcaggttatctgctttcattcagggcaacaaatgatacaaatggtgccagggagtggcaaggccatgggggtaggtgggggtgtctttttcttttcataaagtaacaacagacgagactgaggttaaacatcagaaaaaaacctctggaatgaccttcctcattccaggaggccctggaataaggaagaggcttctttctgagggagctttgaggaattttgacagctgttgacatgggatttgggaaaggtgaagctgtgactggaggggcaggagatggtccaagtgtccatccagagatgagactcttagaatcaaagtgttcagcccaggaagtcttggagatcccaccttctgtggccctgcaccttatgggaagccattaagggggctcatctaggaattctggttacagcccagtgctcatcccagcgtatgctgcctctttagggcagccccaagggccagccagcctgtactctgggcaagagcccaaaatggctaggaatgtttgactcccttaatctcttccccagctacagaggaatcttttctctgcctggtctcagaatgggactgccaactggctcattggtgggagacacagtatcctcaaacctgtggccactggcatgacagtggtgctctgtctccctgggtgacacccaccctaggcttcctcctggatgtgatggggattgccagagaggctcttagcataaaaggcattaggtgggcatttttctgtgtgcccccaaaaagctccatggaaacaggcacctggtagctgcggaacacccgtggacttgtgtatatggtcataggctttgggaagacaggacgtaaaggaaaatgagagaaacaaaatgggtcagatagctttggccacagccccaggcagcctttggggcctatgacacttagtgcccttagatgggatacatcttgcctcggccccaagactcctccaacttacccgtcccatccagggcctgcacagcttagagaggctcacagcttggcaaatgctagggcttcatcagaccactgacttgactcagtgtttgttaaaatggaaccactcccgttggcctactgtttctctcctgtacttcttgtaatgatagttatttattgactctggtagcaggcagttcttaaataaagatggtttctcaacctgttggggaagctggcacgagctgtgggtgttatcatcaggctaaagcatacctccttgtcctgttcttcactccagaggcttttatccaagaatttctttaccccccacacagtgaaatataagtaagttacaacatacagtctatattgcttcatccagtcccaggaggagggaaaaattaggccaagatcttaaggcaggtccaagcagagcacaggcaggcatttggctagaatcagttggctttacctaatacagtggcagtaaacaatgcttatgtgatggtactgcttcaaggtggcctgatttttaagacatctttgaggtgttgactcagtggtcccaaaggaaagtctccctgcagatatattaatgatacccaactggtgagaacgaggctgctgcctctactcttggttcacagcagccacaagggtgtgaattactagtcactttccagccacactttctcacacattcgataaccatttatcaaa

SEQ ID NO: 122079 - DNA, 4948 bp, Homo sapiens
  Payload ID: 3933
  Gene Symbol: CNTN3
  Gene Name: contactin 3 (plasmacytoma associated)
  Uniprot ID: Q9P232
  ENST ID: ENST00000263665
  CDS Start-End: 29-3115
gagttactcttgcatttggcaattaaagatgatgtttccatggaaacagttgatcctgctttcattcattggctgcttaggaggtgagcttctcttacaaggccctgtatttatcaaagaacccagcaacagcattttccctgttggttcagaagataaaaaaataactttgcattgtgaagcaagaggcaatccatcacctcattacagatggcagctgaatggaagtgatattgatatgagtatggaacatcgttataagttgaatggaggaaatcttgtggttattaatcccaacagaaattgggatacaggaacttaccaatgttttgcaacaaattcacttggaacaattgtcagcagagaagccaaacttcagtttgcctatcttgaaaattttaaaaccaaaatgaggagtacagtgtctgtgcgtgaaggccagggagttgtgctgctctgcggccccccaccacactctggagaactgtcatatgcttggatcttcaatgaatacccatcgtttgttgaagaagatagtcggagatttgtctcccaggagacagggcacctctacatatctaaggtggagccgtctgatgtgggaaattacacatgtgtggtgacaagtatggtgacaaatgcccgagtgctgggctctccaactcctttggtgctacgttctgatggtgtgatgggtgaatatgaacctaaaatagaagttcagtttccagaaactcttccagcagctaaaggttcgactgtgaaattggaatgttttgcccttggaaatcccatacctcagattaattggagaagaagtgatgggctgccattttccagcaaaattaaattaaggaagttcagtggtgtgcttgaaatccccaacttccaacaggaagatgcaggttcctatgaatgcattgctgagaattcacgaggaaaaaatgttgccagagggcgtctcacttactatgcaaagccccattgggttcaactcataaaggatgtggaaatagccgtggaggacagtctttattgggaatgcagggcaagcggcaagcccaagccttcctaccgatggctgaaaaatggagcagccctggtgctagaggagagaacacagatagaaaatggtgcccttacaatatcaaacctaagtgtgactgattctggcatgttccaatgcatagcagaaaacaaacatggccttgtttattccagtgctgagctcaaagttgttgcttctgctccagatttttcaaagaatccaatgaagaagttggttcaggtgcaggtgggcagcctggtcagcttggattgtaaacccagagcctccccaagggcactctcttcctggaagaagggggatgtgagcgtgcaggagcatgaaagaatttctttgttaaacgatggaggactcaaaatagccaatgtgactaaagctgatgctggaacttacacctgcatggcagaaaaccagtttgggaaagcaaatggcacaacacatttggttgttacggaaccaacaagaataactttggcaccatctaacatggatgtttctgttggtgaaagcgtcatattgccctgccaggtacaacatgacccgctgttagacatcatctttacctggtatttcaatggggcccttgcagattttaagaaagatggatctcactttgagaaagttggtgggagttcatctggtgatttaatgatcagaaacattcagctgaaacacagtgggaaatatgtttgtatggtgcaaacgggggtggacagtgtttcatctgctgctgacctcatagtaagaggttcacctggaccaccagaaaatgtgaaggtagatgaaattacagacacaacagcccaactctcttggaaagaaggtaaagacaaccatagcccagttatatcctattctatccaggctcggacacctttctccgtgggttggcaaaccgtcacaacagtgcctgaggtcatcgatgggaagacgcacacagccactgtagttgagttaaacccatgggtggaatatgaatttcgggttgtagccagtaacaaaattggaggtggagaaccaagtttaccctcagaaaaagtaagaactgaagaggcagttccagaagtgcctccttctgaagtcaatggaggaggcggaagccggtctgaacttgtgataacctgggatccagtccctgaagaactacagaatggtgaaggttttgggtatgttgttgctttccgccctcttggggttaccacctggatccagacagtggtgacatcccctgacaccccaagatatgtctttaggaatgaaagcatcgtgccatattcaccatatgaagttaaagtgggtgtttataataacaaaggtgaaggaccatttagcccagtgacaacagtgttctctgcagaagaagagcctacagtggccccatctcaagtctctgcaaatagcctatcttcctcagaaattgaggtttcatggaacaccattccttggaagttgagcaatggacatttactgggctatgaggtgcggtactggaatgggggtggaaaggaggaatcatccagtaagatgaaagtggcaggaaatgagacatcagccagactacggggcctgaagagcaacctggcctattacacggctgtccgggcttacaacagtgccggcgctgggccttttagcgccacagttaatgtaaccaccaagaaaacgcctcccagtcagccaccaggaaatgttgtttggaatgccacagacactaaagtgttacttaattgggagcaagttaaagccatggagaatgagtcagaagtaacaggatataaagttttctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtatggatgcaagaggatccacttcagccatctcgaatgtccaccctatgtcaagttatatgcctatagtactgttcttaattgtatatgtcctgtggtgatattaactcctttttattatttattggaaagttatttggttaccaaaaaaagtgctttcatgaaatgcagtgattatgcatgtttttttcaactcttatttttaactttctacttcattataggtaaatatgaatataattaaaaaaacagtaaatccttttaggggaatctgaaatgccttaatattaacttgataaaccaaaggaatttacatattacatacttcagacttttgatataaatgttcttaaactatgagtttaagcactgcctatggataaagactcacacactctcacatgtacacacacacgcatgagaatttctttttacattgaaaaactctttcatttaattcaaatgctattttcccattataatagcattatttggaagacttaaccagtatcaatttgaaatgctgatttaagtccccaaggatgaaaaatacattttaaaaattattttgttggagaggagtggcatgtgattcaaaagagcattgttggaaaatgctactgtggggcttagaagaatgatgtttggtttggtatgctgctaactagttgtaagactttacaaatcactttgccatctgtacctctcaattattcctctataaaatatggagataataatacctatctgatcagactttgccccatgaattagtttttaaaagataaagactgaagtatgaaagtgcttttgtcaccccaaatgcaattgacccatgcaaaatattagcatgaatttatttaatcacataaaagtcatgaagaccagccagattttcaagcttcattctgtttcattcagttatattccaaaattcaaatgatcacattttattctttctcaaaaaaaaaaagtttttttaaattaaaaaaggaattgtttccttcacagctatgaataagctttcaggttttattaaaacctagaggaaaaaatcaggaatgacctgaatctcaacccaaatattaaacaaaatccacataatccctcatttcaatttccaattccattaagggaccctctctttttggatggcagagatggttttttaatgaaatcccaccatctatctgagtgagtctggcaggctttttagttcctgagttaaatttgtaatagaaccaaggcaatgctgctgactttgatatgtatgactcagtctttcaatatgtggttttcaaaaaattgttgaagacgtgacttcatagcaatatatagagaataaattaaaatcagcagattgagttttcaacattgcaaaatcagttttttacctctttcctaccaatttcacattttgcagaaacttgttcacatttccaacaatatcagaattagaaaacagttcagataacaagaaagattaaaaattagggaaattctgatatcaccataaagcactattttacatttagagattacatttaagataaagtcatcatacacaaaaacaataaatatttataactttctctataaggtccgcatatactgtatatattgaaacaatctgaatgactagtagatttcatatgaccattgttatttccactttctccaatacttgtattttatgctacatgtaatgaagttggacctttttattatttagtaattcctatatgttcctatacttttcattttcaagatgattgctctattgtttcatgttgtttctagcaatatatctccatgagatatgcactttgtttcatattgaaaagtataaaatttatctttcaattcctgtgtgtgtatcctatggttatctgtatgtattattttctattctaataaaatttataacaagcaaa

SEQ ID NO: 122080 - DNA, 2322 bp, Homo sapiens
  Payload ID: 3934
  Gene Symbol: CNTN4
  Gene Name: contactin 4
  Uniprot ID: Q8IWV2
  ENST ID: ENST00000397459
  CDS Start-End: 91-2187
gttctatgttcccagtgggaacataccagatggaggctttgatttgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttcttt

SEQ ID NO: 122081 - DNA, 5198 bp, Homo sapiens
  Payload ID: 3934
  Gene Symbol: CNTN4
  Gene Name: contactin 4
  Uniprot ID: Q8IWV2
  ENST ID: ENST00000397461
  CDS Start-End: 385-3465
gccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatt

SEQ ID NO: 122082 - DNA, 566 bp, Homo sapiens
  Payload ID: 3934
  Gene Symbol: CNTN4
  Gene Name: contactin 4
  ENST ID: ENST00000455083
  CDS Start-End: 403-566
aagtagggagctttcgccgccgccccgggcccctcggactgtgccggcgccgcacccgaggctctcgccagcccggcgccccggtgctgagtgggtgaaaaagaacagtgtgtcatgaagacaggcacctggaggtgatttgggtggcattcatgagaaaattcacgttacccacttcgctaactgatgaaacactgccagagcccacttggactgtttcgcaactttacttaagggaataaaagctctcatgctgaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaa

SEQ ID NO: 122083 - DNA, 5093 bp, Homo sapiens
  Payload ID: 3934
  Gene Symbol: CNTN4
  Gene Name: contactin 4
  Uniprot ID: Q8IWV2
  ENST ID: ENST00000418658
  CDS Start-End: 280-3360
ctgtgccggcgccgcacccgaggctctcgccagcccggcgccccggtgctgagtgggtgaaaaagaacagtgtgtcatgaagacaggcacctggaggtgatttgggtggcattcatgagaaaattcacgttacccgaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatt

SEQ ID NO: 122084 - DNA, 3057 bp, Homo sapiens
  Payload ID: 3934
  Gene Symbol: CNTN4
  Gene Name: contactin 4
  ENST ID: ENST00000427741
  CDS Start-End: 634-1332
gttcgacgccaggattggctgcaagtagggagctttcgccgccgccccgggcccctcggactgtgccggcgccgcacccgaggctctcgccagcccggcgccccggtgctgagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatgtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatg

SEQ ID NO: 122085 - DNA, 528 bp, Homo sapiens
  Payload ID: 3934
  Gene Symbol: CNTN4
  Gene Name: contactin 4
  ENST ID: ENST00000434053
  CDS Start-End: 117-528
gaaactgggacattttactttacagtctattaaaggttatacaaaacttaaaagaagcagcaattctattcgcttgttattggacttgaaactccctttgacctcggaaactgaagatgaggttgccatgggaactgctggtactgcaatcattcattttgtgccttgcaggttcacagactgacttctggtccttgctgggggtgctgccagccttggaggctgatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgctt

SEQ ID NO: 122086 - DNA, 658 bp, Homo sapiens
  Payload ID: 3934
  Gene Symbol: CNTN4
  Gene Name: contactin 4
  ENST ID: ENST00000422330
  CDS Start-End: 311-658
agccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagctt

SEQ ID NO: 122087 - DNA, 4980 bp, Homo sapiens
  Payload ID: 3934
  Gene Symbol: CNTN4
  Gene Name: contactin 4
  Uniprot ID: Q8IWV2
  ENST ID: ENST00000427331
  CDS Start-End: 164-3244
agtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgt

SEQ ID NO: 122088 - DNA, 726 bp, Homo sapiens
  Payload ID: 3934
  Gene Symbol: CNTN4
  Gene Name: contactin 4
  ENST ID: ENST00000473845
  CDS Start-End: 1-432
aatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagta

SEQ ID NO: 122089 - DNA, 5925 bp, Homo sapiens
  Payload ID: 3935
  Gene Symbol: CNTN5
  Gene Name: contactin 5
  ENST ID: ENST00000279463
  CDS Start-End: 6-3260
tttctcttacagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 122090 - DNA, 3679 bp, Homo sapiens
  Payload ID: 3935
  Gene Symbol: CNTN5
  Gene Name: contactin 5
  Uniprot ID: O94779
  ENST ID: ENST00000418526
  CDS Start-End: 77-3157
aaacagggcactctttaatgaagaaacaccagagctgttaaacacattgagacacagaagattctagtgactgaggatggcttcctcttggaaactaatgctgtttctgtcagtcaccatgtgtctttcagaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagata

SEQ ID NO: 122091 - DNA, 4303 bp, Homo sapiens
  Payload ID: 3935
  Gene Symbol: CNTN5
  Gene Name: contactin 5
  Uniprot ID: O94779
  ENST ID: ENST00000527185
  CDS Start-End: 340-3075
aattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggtatgaacagaatgattgaaaataagccttattgtttcttctgacatcacattctcctaaagagaggttttggtgacacctcagaatttcaacagaatttcttagaaattttgctctatgttaaagaaactaagaaatactattttactgggatgtgttatgttgctcattaactggtttatttttcagtacagtagcttccgtagcactatgcaaagatgtttttaaaagatgaaatagagttttagacaaaagcaggagctacaggtagatatttaattgtatccaatttactggtcattttaaaagtttttgtgtcttcctttctaataatttaatgtataaatacaagttttccttttgtactttattggtatctcttaccctcagtgctgaattatcaaattttgcttggaatttaatgatctgtattgtatctatgtattcagatagtttttttggtcccttaaatgttgctatttttaaacatagttattccagccttataatggtgaacatttcatatcaaatgaataacatcaatgaaattttagcctccgcagagaatagcagattgtgagtagtctgtgaacatgaatattttatgataacaaggtttggcttctcacacagctcttgttcttgttcttgccttgcttggccagtcatggagaggaattagggggataatgtctaaaagaaaaaaagaattagcatctgacccaagactttagttgcatttaaaaaaatttattcttacttttcctctgcttcagttcccattaagagaaaatcatcttgtgtcttgaacaatgatcaagtataggacttgtatactaacatggtttccaggctgaaacatatttttaattctatttgagttttcaaataatgcccaacaattatttgattaacatacagctggcattaaataatgatttctatgataaaaaaatttatacaatctttctaagagttacagcaagaacaatttatgggaaaccattacctacttatacaatatcatggacttatttctacaatcttgcttcaattaattatttggaatgataatttagtatctcattatgattgcatgtttaatgtgatgaatatttctgtttctcccaatccatgcttcagggaccatgtttgttcatcattaaatctcagcaaatgataatatatatatttggcccataactgaccacaataaatatgttgaatgaataaa

SEQ ID NO: 122092 - DNA, 6258 bp, Homo sapiens
  Payload ID: 3935
  Gene Symbol: CNTN5
  Gene Name: contactin 5
  Uniprot ID: O94779
  ENST ID: ENST00000524871
  CDS Start-End: 291-3593
gaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 122093 - DNA, 3800 bp, Homo sapiens
  Payload ID: 3935
  Gene Symbol: CNTN5
  Gene Name: contactin 5
  Uniprot ID: O94779
  ENST ID: ENST00000528682
  CDS Start-End: 152-3454
gaactgtgctgatgggcaggaggatgggagacaggaattgagagtcacagaggaaggacagtggagtctggcatcttattgggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatt

SEQ ID NO: 122094 - DNA, 5734 bp, Homo sapiens
  Payload ID: 3935
  Gene Symbol: CNTN5
  Gene Name: contactin 5
  ENST ID: ENST00000619298
  CDS Start-End: 1-3069
gctagtttaaggaaatttaaaatgtgtctgttttgtcttacagaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 122095 - DNA, 3814 bp, Homo sapiens
  Payload ID: 3936
  Gene Symbol: CNTN6
  Gene Name: contactin 6
  Uniprot ID: Q9UQ52
  ENST ID: ENST00000350110
  CDS Start-End: 552-3638
aagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctactcttgagatactgactggaagatagactgttttgttccacctgattgtatgggagaaatttttgaccttagaaagtggaaatgaggttgctatggaaactggtaattctgctgccactcataaactcttctgcaggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaatccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatgctcctccagaatgggaacagaaaatccaaaatacacacctctctatctatgacaacttgctctgggaatgtaaagctagtggaaagccaaacccttggtatacatggttaaaaaatggtgaacgactcaacccagaggagagaattcaaatagaaaatgggacactcatcataacgatgctgaatgtgtcagattctggtgtgtaccaatgtgctgcagaaaacaaatatcagataatttatgcaaatgctgaattgagagttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaagaatatttctcttggaggatggcagcctcaagatatataatattaccaggtcagatgctggatcatatacatgcatagccacaaatcagtttggcactgcaaagaacactggcagcctcattgtaaaagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagaatctgttggggatttgatgataaggaatattcagttacatcattcaggaaaatatctctgcacagtacaaacaaccctagaaagtttatctgcagtagccgatatcattgttagaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcagtccctgttgtggcaccagtaaacatccatggaggtggaggaagtcggtctgaactcgtcattacgtgggagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatgaacctcaactggccccaaggggaacttctctccagagtttttctgcttctgaaatggaggtttcatggaatgctattgcctggaatagaaacactggaagagtgctgggctatgaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaaca

SEQ ID NO: 122096 - DNA, 1433 bp, Homo sapiens
  Payload ID: 3936
  Gene Symbol: CNTN6
  Gene Name: contactin 6
  ENST ID: ENST00000394261
  CDS Start-End: 191-316
atacggcttggttctgcctggacgcacagcatgcctggctgagagcttgaaacagagttctgcagaaaaactgtaaagatcccgagacatttccctgactcttgagatactgactggaagatagactgttttgttccacctgattgtatgggagaaatttttgaccttagaaagtggaaatgaggttgctatggaaactggtaattctgctgccactcataaactcttctgcagaaaagtttatatcagtccaattctgctgctaactggacttcgtctctggcttcttcatttggaaatctacctcttatgctaagtgcccttatatcacctggcggtttgcaaagaggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaagtaaggtttttgtttttgtttttgttttcctggttgcattaatttttttttattaaaaacctttttgttattcatatattgctctaaggtaaattaccaagtagatttcaaatgctgggcaacagtggaactttctgatttgaatttaaacaaacatgtctaatactgagacaatgaccaggcctgtaactgaaaatgatcagggctgcaattcttccctacaggtgctgatatttccttagtttaagcataatgagacccatttaggcagcacattgcaagggaataagtgcactcgtataagatgatgggcaagtcactaaaccttccacatatccttcactccatcttgtcctacatccagaaatacattgcctg

SEQ ID NO: 122097 - DNA, 3519 bp, Homo sapiens
  Payload ID: 3936
  Gene Symbol: CNTN6
  Gene Name: contactin 6
  ENST ID: ENST00000397479
  CDS Start-End: 79-270
aataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaatccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatgctcctccagaatgggaacagaaaatccaaaatacacacctctctatctatgacaacttgctctgggaatgtaaagctagtggaaagccaaacccttggtatacatggttaaaaaatggtgaacgactcaacccagaggagagaattcaaatagaaaatgggacactcatcataacgatgctgaatgtgtcagattctggtgtgtaccaatgtgctgcagaaaacaaatatcagataatttatgcaaatgctgaattgagagttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaagaatatttctcttggaggatggcagcctcaagatatataatattaccaggtcagatgctggatcatatacatgcatagccacaaatcagtttggcactgcaaagaacactggcagcctcattgtaaaagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagaatctgttggggatttgatgataaggaatattcagttacatcattcaggaaaatatctctgcacagtacaaacaaccctagaaagtttatctgcagtagccgatatcattgttagaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcagtccctgttgtggcaccagtaaacatccatggaggtggaggaagtcggtctgaactcgtcattacgtgggagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatgaacctcaactggccccaaggggaacttctctccagagtttttctgcttctgaaatggaggtttcatggaatgctattgcctggaatagaaacactggaagagtgctgggctatgaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgag

SEQ ID NO: 122098 - DNA, 4513 bp, Homo sapiens
  Payload ID: 3936
  Gene Symbol: CNTN6
  Gene Name: contactin 6
  Uniprot ID: Q9UQ52
  ENST ID: ENST00000446702
  CDS Start-End: 628-3714
aatgcagtgaaaccagaggaagaaaaaaattacttcctttcctgttggaaacctaataagtagttagtctgacccagttttcaataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctgactcttgagatactgactggaagatagactgttttgttccacctgattgtatgggagaaatttttgaccttagaaagtggaaatgaggttgctatggaaactggtaattctgctgccactcataaactcttctgcaggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaatccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatgctcctccagaatgggaacagaaaatccaaaatacacacctctctatctatgacaacttgctctgggaatgtaaagctagtggaaagccaaacccttggtatacatggttaaaaaatggtgaacgactcaacccagaggagagaattcaaatagaaaatgggacactcatcataacgatgctgaatgtgtcagattctggtgtgtaccaatgtgctgcagaaaacaaatatcagataatttatgcaaatgctgaattgagagttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaagaatatttctcttggaggatggcagcctcaagatatataatattaccaggtcagatgctggatcatatacatgcatagccacaaatcagtttggcactgcaaagaacactggcagcctcattgtaaaagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagaatctgttggggatttgatgataaggaatattcagttacatcattcaggaaaatatctctgcacagtacaaacaaccctagaaagtttatctgcagtagccgatatcattgttagaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcagtccctgttgtggcaccagtaaacatccatggaggtggaggaagtcggtctgaactcgtcattacgtgggagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatgaacctcaactggccccaaggggaacttctctccagagtttttctgcttctgaaatggaggtttcatggaatgctattgcctggaatagaaacactggaagagtgctgggctatgaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaacacttttgaattttaaaatccgcacatgattacatgaattcctaggtgccacattaacctggggagttgtaactgctgtgtcttttaagttacttatatggagaaaataaataactcccctcaatgatgctgatgatgaatacaaacttggctcctagttaccataactcacatgtacatttttatgtattccagacaatcacttcagtatttaaaatttccaccctacttcaaaataaaatacaattatttgtttatagttgggattctttaaaaatacaaactattccaaagcatggggtgcttttatctctgaatcaagttggaataagaaatctttttactcaagaatatttcaatatacatgatgttcttctcagcccacttttcagaagattcagtcacaataaaggcagaaaaagtattttatggcaaagaaaaataaatgatgggaaatgagcacccacctaaaataatcttctaacaactctggtatatattaagcaattgctcatggcaaagttgaacatttgaactgctgcatgaacaaatctcaggtaattatgacaagttgattgcaatgtatgtggccttatttttataataaaacaatgtggaaacagaa

SEQ ID NO: 122099 - DNA, 551 bp, Homo sapiens
  Payload ID: 3936
  Gene Symbol: CNTN6
  Gene Name: contactin 6
  ENST ID: ENST00000413210
  CDS Start-End: 15-206
gaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctgaatgcctactctgaggccttaattctcacatctgatgataccctgaggatgacatgtgaggccaagagggagtgaagcctcatccccactttgtgcttctttattaaccagactcttgagatactgactggaagatagactgttttgttcca

SEQ ID NO: 122100 - DNA, 5276 bp, Homo sapiens
  Payload ID: 3937
  Gene Symbol: CNTNAP1
  Gene Name: contactin associated protein 1
  Uniprot ID: P78357
  ENST ID: ENST00000264638
  CDS Start-End: 218-4372
gaagagcggaggaccaggaaccagagagagagagagagaaaagagagaggagagacagagcgcttgggggcgaaaggagagagggagggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctggggctactacggctgcgacgaggagctggtgggtcccctgtatgcacgctccctgggcgcctcctcctactacagtctccttactgcgccgagattcgccaggctgcacggcataagcgggtggtcaccacggattggggatccgaatccctggctccagatagacttaatgaagaagcaccggatccgggccgtggccacacagggctcctttaattcttgggactgggtcacacgttacatgctactctacggcgaccgagtggacagctggacaccgttctaccagcgagggcacaactcgaccttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacaaggccgacatactctatttcgacggcgacgatgccatctcctaccgcttcccgcgaggggtcagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgagatgttcatcggaggtctggtgggcgccgcgcggaagaacctggcctatcggcataacttccgcggctgcatagaaaacgtaatcttcaaccgcgtcaacatcgcagacctggccgtgcggcgccattcccggatcaccttcgagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctgggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtgcagccctaacatgtgtgagcatgatggacgctgctaccagtcttgggatgacttcatttgctactgcgaactgacgggctacaagggagagacctgccacacacctttgtataaggaatcctgtgaggcttatcggctcagtgggaaaacttctggaaacttcaccattgatcctgatggcagtggccccctgaagccatttgtagtgtactgtgatatccgagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatggagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccagacttcccctactaccatgatgaaggatgggttgccatacttttaggctttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggc

SEQ ID NO: 122101 - DNA, 4499 bp, Homo sapiens
  Payload ID: 3937
  Gene Symbol: CNTNAP1
  Gene Name: contactin associated protein 1
  ENST ID: ENST00000591662
  CDS Start-End: 132-2354
gggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctggggctactacggctgcgacgaggagctggtgggtcccctgtatgcacgctccctgggcgcctcctcctactacagtctccttactgcgccgagattcgccaggctgcacggcataagcgggtggtcaccacggattggggatccgaatccctggctccagatagacttaatgaagaagcaccggatccgggccgtggccacacagggctcctttaattcttgggactgggtcacacgttacatgctactctacggcgaccgagtggacagctggacaccgttctaccagcgagggcacaactcgaccttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacaaggccgacatactctatttcgacggcgacgatgccatctcctaccgcttcccgcgaggggtcagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgagatgttcatcggaggtctggtgggcgccgcgcggaagaacctggcctatcggcataacttccgcggctgcatagaaaacgtaatcttcaaccgcgtcaacatcgcagacctggccgtgcggcgccattcccggatcaccttcgagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctgggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtgcagccctaacatgtgtgagcatgatggacgctgctaccagtcttgggatgacttcatttgctactgcgaactgacgggctacaagggagagacctgccacacacctttgtataaggaatcctgtgaggcttatcggctcagtgggaaaacttctggaaacttcaccattgatcctgatggcagtggccccctgaagccatttgtagtgtactgtgatatccgagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatggagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccagacttcccctactaccatgatgaaggatgggttgccatacttttaggctttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccagg

SEQ ID NO: 122102 - DNA, 9896 bp, Homo sapiens
  Payload ID: 3938
  Gene Symbol: CNTNAP2
  Gene Name: contactin associated protein-like 2
  Uniprot ID: Q9UHC6
  ENST ID: ENST00000361727
  CDS Start-End: 519-4514
acacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtgggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacagatgtgtgcccaatcactgtgagcatggtggaaagtgctcgcaaacatgggacagcttcaaatgcacttgtgatgagacaggatacagtggggccacctgccacaactctatctacgagccttcctgtgaagcctacaaacacctaggacagacatcaaattattactggatagatcctgatggcagcggacctctggggcctctgaaagtttactgcaacatgacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggaggaaggatgctggtttcttatcatacaaagatcacctgccagtgagccaagtggtggttggagatactgaccgtcaaggctcagaagccaaattgagcgtaggtcctctgcgctgccaaggagacaggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaaaa

SEQ ID NO: 122103 - DNA, 6076 bp, Homo sapiens
  Payload ID: 3938
  Gene Symbol: CNTNAP2
  Gene Name: contactin associated protein-like 2
  Uniprot ID: Q9UHC6
  ENST ID: ENST00000613345
  CDS Start-End: 368-694
agtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcagattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtaatatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaaaa

SEQ ID NO: 122104 - DNA, 676 bp, Homo sapiens
  Payload ID: 3938
  Gene Symbol: CNTNAP2
  Gene Name: contactin associated protein-like 2
  ENST ID: ENST00000625365
  CDS Start-End: 318-676
gctgatggaccccggccggtcggctcagtctcccttttgctttcaaacgaggccagggcagggcagaagggttttgacagccagagggtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacac

SEQ ID NO: 122105 - DNA, 6076 bp, Homo sapiens
  Payload ID: 3938
  Gene Symbol: CNTNAP2
  Gene Name: contactin associated protein-like 2
  Uniprot ID: Q9UHC6
  ENST ID: ENST00000463592
  CDS Start-End: 368-694
agtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaaaa

SEQ ID NO: 122106 - DNA, 1944 bp, Homo sapiens
  Payload ID: 3938
  Gene Symbol: CNTNAP2
  Gene Name: contactin associated protein-like 2
  ENST ID: ENST00000628930
  CDS Start-End: 448-1620
taagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccg

SEQ ID NO: 122107 - DNA, 6368 bp, Homo sapiens
  Payload ID: 3938
  Gene Symbol: CNTNAP2
  Gene Name: contactin associated protein-like 2
  ENST ID: ENST00000633607
  CDS Start-End: 1-986
atgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcagattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtaatatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaaaa

SEQ ID NO: 122108 - DNA, 1310 bp, Homo sapiens
  Payload ID: 3938
  Gene Symbol: CNTNAP2
  Gene Name: contactin associated protein-like 2
  ENST ID: ENST00000633544
  CDS Start-End: 1-986
atgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcagattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtaatatctgtcttattttgtgtgtgtttagaggtgttctaaagacccg

SEQ ID NO: 122109 - DNA, 5064 bp, Homo sapiens
  Payload ID: 3939
  Gene Symbol: CNTNAP3
  Gene Name: contactin associated protein-like 3
  Uniprot ID: Q9BZ76
  ENST ID: ENST00000297668
  CDS Start-End: 75-3941
cgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagcagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggttaaccagagcacaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcagcgggggcggcgtccggctccccggcgcgggaactggctccccgactcgcggggggcgcaggtcgttctggaccagcggatgagggagagcccttggttaatgcagacagaagagactctgctgtcatcggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgctgtcacctggctgaagacctgcagcctcggagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatggctataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacaatacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaatagcttaactgaa

SEQ ID NO: 122110 - DNA, 4885 bp, Homo sapiens
  Payload ID: 3939
  Gene Symbol: CNTNAP3
  Gene Name: contactin associated protein-like 3
  ENST ID: ENST00000358144
  CDS Start-End: 57-3176
ggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagcagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggtaatcccacaaatgcaaaagtcaaactaactaatattattattttaagaacaaataatctaatgaaaaaatttgataatattaatagaagagcaacccattcagtgctgctcttccataagtcaagaagaagccaaatatggccaggatctgggagagaggaggtggttgtttattctgtattgctttgttttgtttgtttagcaatgcaattctgtcaaaggtattattaatattttactatttaaaatatcaaaatatctatttgttttactttactcaataggggaatgttctctagtttatcatagtgactgctggtggaatctattcattgatactgcagtgggaacttgtcttattctgattataaaagaacaaatactttagcaacttaaaaacacggtttaaaagcacacaacatagttattaaaatgggaataagtaagaaaatagacctgagtcaccacagaggaagtaaattacacattgtcatcggcattggaaggaaaatatactgtatagagaacaacaatgcttggttttatgtttcagattttctccacagaatgagtacatatttaagtttaaaacaaccaattccatctttttcatggattctgccaattatagatccttccattatgaagaagagtaaagccagcaagtgggtacatcgtggatagagtggtagctgatggcatcataggaattgcttataaaatagcttctctttctaaatgattaattatttgaaggtggcttcttgagcttttgtaatggtacttaaaagtgatttattttcatctttcctttcctcatcttcctttgcttccttatcattaaaattgtactttctgttgatgtttgcttctcatgggacatctaataggttaaccagagcacaaagaaacaagtcatcttgtcctcagggacagaattcaacgccgtcaaatctctcatattgggaaaggttttaggtaagtaggagaaagagctttttcccaaataagtgtcatgtcacaaactctggaagcattcatcatgctgaaagaagctccttgtcttacttgaataataatttcacagtgagtgacaatcaaggtgcaaactgtactcttgcctgagtgtacatataatcatgactaagtgctacctgtgagatgtgcaagggcgttcctggaaaaatacctccacacttaacctctcacttggcaatcatgcataatgaatcacggtatttttctaatccttcttgaaaagtgaaatgttgtcaaagctgacacgaagttcacagattatgtatgtattaatcaacatcaactccggagaccatcattcaatgataaaactacgtttgagttgaacacaagagaaaaaactggtaatcttattacagcagatgaatacagttttatttttctctcaagccctgctttgcctgttgtttccatcctttttgactttagtatctaacaggaatggggaggcatattcataaatatctgttacgcaaggtagaaagttacagtaattgtctatcatattgtctatcataatctgttgtaaaagcacagttagctttacatttaataaaggaactgaggaaagtaatctttttttaaaaaaacccatcttatgtaactcaattaagaaaatgaactatactttaatattaggatcaaaaagttgaataatatttattatatacatctttgtttccttccaaataaaggaga

SEQ ID NO: 122111 - DNA, 4986 bp, Homo sapiens
  Payload ID: 3939
  Gene Symbol: CNTNAP3
  Gene Name: contactin associated protein-like 3
  ENST ID: ENST00000377656
  CDS Start-End: 240-3863
agaaagctgcggcgcgagtccgcggggccgacctcggagacgcagctggggccgggcgcggcttggcgggagggtctgcagcgccgagggaggctgctggtgcgtgaggaagagagctagagactggacaggggaggcagagcagcgtcagagccgcgcaggggacgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggttaaccagagcacaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcagcgggggcggcgtccggctccccggcgcgggaactggctccccgactcgcggggggcgcaggtcgttctggaccagcggatgagggagagcccttggttaatgcagacagaagagactctgctgtcatcggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgctgtcacctggctgaagacctgcagcctcggagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatggctataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacaatacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaatagcttaactgaa

SEQ ID NO: 122112 - DNA, 2649 bp, Homo sapiens
  Payload ID: 3939
  Gene Symbol: CNTNAP3
  Gene Name: contactin associated protein-like 3
  ENST ID: ENST00000377659
  CDS Start-End: 240-2477
agaaagctgcggcgcgagtccgcggggccgacctcggagacgcagctggggccgggcgcggcttggcgggagggtctgcagcgccgagggaggctgctggtgcgtgaggaagagagctagagactggacaggggaggcagagcagcgtcagagccgcgcaggggacgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggtgatttccacatgatttccctgcacaaaaatgtggtttttattctttaattatgcatagttaattaaatgtcagacaagctggtacaataaggtaactaaagtatgttcaagcaagctgaaatacaagttttgatgaaatatgatcagttaatctaaggattaaattttatgacc

SEQ ID NO: 122113 - DNA, 2411 bp, Homo sapiens
  Payload ID: 3939
  Gene Symbol: CNTNAP3
  Gene Name: contactin associated protein-like 3
  ENST ID: ENST00000443583
  CDS Start-End: 252-2066
cccgagcgctccagaaagctgcggcgcgagtccgcggggccgacctcggagacgcagctggggccgggcgcggcttggcgggagggtctgcagcgccgagggaggctgctggtgcgtgaggaagagagctagagactggacaggggaggcagagcagcgtcagagccgcgcaggggacgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggagctctctacgagcagtcttgtgaagcccacaagcaccgagggaacccgtctgggctttactatattgatgcagatggaagtggccccctgggaccatttcttgtgtactgcaatatgacagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgaggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtggtaagctcgccactctggacaagtcacagggtacccattatttagcaataaaagctttaactc

SEQ ID NO: 122114 - DNA, 3240 bp, Homo sapiens
  Payload ID: 3940
  Gene Symbol: CNTNAP3B
  Gene Name: contactin associated protein-like 3B
  Uniprot ID: Q96NU0
  ENST ID: ENST00000276974
  CDS Start-End: 417-1559
tgggagagagggacggaggaagctgccggtataacgggaggagagcgccaggcggagctggggcgtccctcccgctcgcttcttgactcgcgttggtgccggccgcctcccgcgcctagtgtccgggacgcgcctgaacctgccgcctccgtgcctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatggagttggctcatgggttgcaggaccaaaacctgaaaatatctctgactgtgtgtcaccagaccacacaatgaatacatcacttaggttagcatgagaaaaggggaaaaacagctgtgaagcccatgaactttccaagaaggtaaaggagaaaaaaaaaaaaaagttgggtttgaagtctaagttttactatgaacagcaccctgctgagatcataaaaatgaaaaataccatcaagatacatgaaaaaggaaacaccaaagggaagagtgataacaaggctccacagagcgcagtttcctttgacaagatgaaaaagaaatgaaaagaggaaggagataaatggaacagccctctacctaaagtttctgtccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttccaaagacactgtcattgaagtgaggaagagtgagttgggccttatgacacaaagagacaagactatttgaggacaatagacacaggttttcatatacattccatgttattctgaattactgatgggttcgctgatggaattattgagtatagccaataaggagaaccacagttaagctggtgtctctgggttctggatatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttcttgggaaaatcagctgccagaattcattagtcaactaacaagcactcctctgtggcaagaagccctgcttctctgttgtagcaggcagctacccacctaaatgatgaggtcaagaaatatacagctgataaaaagataaaaaatatgtaatagtccagtgattacatgtgtactacggatcagcgccaattagttgtaagcttttggtatttagttcgttacagcaaatgttttcttttttaaattttcttctgcaaatgttttcttgtcatgaaaagtgttttccgtttagcagaattacaaaaatagtcaagaagaaatgttctgattgatgtatacagttagaatgtgtattaaagattattataaaatgataactgaattatatccatttctaaagtatgttgggacaaaattttttaaaaatgtgattctgttttgaaaattgttttaccactggatcagtgtggttcttaaacttggctttatcttggagtcaccagaggagattcaaaagatacctttacctggctccacctccagagatcgggattttaaatggtctgtatctggattttaagagcccttctggtgattcgactgtttagctaggtttgagagccactaccctagatgagctgtcctgctccagtaacattctttttctaaaatcttttatagtatattagaaataaatccatggaaattccaagt

SEQ ID NO: 122115 - DNA, 2426 bp, Homo sapiens
  Payload ID: 3940
  Gene Symbol: CNTNAP3B
  Gene Name: contactin associated protein-like 3B
  ENST ID: ENST00000479351
  CDS Start-End: 264-2081
cctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggagctctctacgagcagtcttgtgaagcccacaagcaccgagggaacccatccgggctttactatattgatgcagatggaagtggccccctgggaccatttcttgtgtactgcaatatgacagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgaggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactc

SEQ ID NO: 122116 - DNA, 2170 bp, Homo sapiens
  Payload ID: 3940
  Gene Symbol: CNTNAP3B
  Gene Name: contactin associated protein-like 3B
  ENST ID: ENST00000617422
  CDS Start-End: 32-1990
ccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggagctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggtgatttccacatgatttccctgcacaaaaatgtggtttttattctttaattatgcatagttaattaaatgtcagacaagctggtacaataaggtaactagattaaagtatgttcaagcaagctgaaatacaagttttgatgaaatatgatcagttaatctaaggattaaattttatgaccaaa

SEQ ID NO: 122117 - DNA, 5379 bp, Homo sapiens
  Payload ID: 3940
  Gene Symbol: CNTNAP3B
  Gene Name: contactin associated protein-like 3B
  ENST ID: ENST00000377561
  CDS Start-End: 394-4260
tgccggtataacgggaggagagcgccaggcggagctggggcgtccctcccgctcgcttcttgactcgcgttggtgccggccgcctcccgcgcctagtgtccgggacgcgcctgaacctgccgcctccgtgcctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatgagatttccgcatatttcgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggctgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtcgttctggaccagtggatgagggagagcccttggttaatgcagacagaagagactctgctgtcatcggaggtgtgatagcagtggagatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatattataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttcatcattcatttctttttctaaaagttgttactgatatgcttttgatttcctatgactctattatgttgtacagaacatcttttcaatttattaaaaaaaatagcttaactgaa

SEQ ID NO: 122118 - DNA, 2666 bp, Homo sapiens
  Payload ID: 3940
  Gene Symbol: CNTNAP3B
  Gene Name: contactin associated protein-like 3B
  ENST ID: ENST00000341990
  CDS Start-End: 252-2489
ccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggtgatttccacatgatttccctgcacaaaaatgtggtttttattctttaattatgcatagttaattaaatgtcagacaagctggtacaataaggtaactagattaaagtatgttcaagcaagctgaaatacaagttttgatgaaatatgatcagttaatctaaggattaaattttatgacc

SEQ ID NO: 122119 - DNA, 3840 bp, Homo sapiens
  Payload ID: 3940
  Gene Symbol: CNTNAP3B
  Gene Name: contactin associated protein-like 3B
  ENST ID: ENST00000619138
  CDS Start-End: 157-3057
gccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggagctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatgagatttccgcatatttcgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgaagtttgcagattaggtacaagctagatagacatcaaaatcctgatgcatttacctttgattttaaaaacatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggctgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtcgttctggaccagtggatgagggagagcccttggttaatgcagacagaagagactctgctgtcatcggaggtgtgatagcagtggagatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgc

SEQ ID NO: 122120 - DNA, 2643 bp, Homo sapiens
  Payload ID: 3940
  Gene Symbol: CNTNAP3B
  Gene Name: contactin associated protein-like 3B
  ENST ID: ENST00000476961
  CDS Start-End: 1-541
cagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttaggtcgttctggaccagtggatgagggagagcccttggttaatgcagacagaagagactctgctgtcatcggaggtgtgatagcagtggagatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatattataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttcatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaa

SEQ ID NO: 122121 - DNA, 7455 bp, Homo sapiens
  Payload ID: 3940
  Gene Symbol: CNTNAP3B
  Gene Name: contactin associated protein-like 3B
  ENST ID: ENST00000612828
  CDS Start-End: 157-3780
gccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattgagatttccgcatatttcgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggctgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtcgttctggaccagtggatgagggagagcccttggttaatgcagacagaagagactctgctgtcatcggaggtgtgatagcagtggagatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatattataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttcatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaagagataaatatttactgattgctagatgtaaaaatatctatgaatatatatatttaaacttctgccagagagcaaccatctgacagtcaacttactaaaatctaaattgagtactttttactgttgcagagaattaagtcactaaacgttatttagatatatagatgctagttgcaagtaacacccttttgtaatataaaagtaaaagcataataatttcccaacttttgtcttcaaattaaaaaagaaaatagcatataattaccattcttcatttgagaaagctgaagattctgatgcttaaaaacttcagaattctaatattaaaaatagagtggttcatgtgacattgaaggcttatctctgtaaaatagtgacactggtgagtggtattatctcaatatttttgtccaaattcaccttaggaagtcactgtaaatcttcattgtttcctaaaagtcattattacggcataaacttaacatactttgatagtagttagtactgatacgtgacatattctaccccgtgtctctgttactctgtctctattactgtgaaaagtcacagtaaatttaacattttcttccagactgtgtatgatctttcattgtaatagagacatggagtaggataagtcatgtattaacatataagatttttttaacctgctccctcagttttatagatgagacaaagataaggttgtaagagctaatctcttcaagtaggcagtactagtaagttgtcatgcgtggactgaactcctggcacttctttctcttaacttcaatccatagagaagcccaccttcctgccttcccagtattatttagcagaggagaaaatcatattaggctgtttgatactctgtttgcctagactgatcaataattctggatctttgttcacatcttctctgaaagaatatttgatgggaaatcttttttattttttaatttttgtgtacatactaggtgcatatatttatggagtacatgaaatgttttgatacaggcatgcactgtgaaataagcacatcatggagaatggggtatccatcccctcaacatttatcctttgtgttacaaacaacctgattacactctgtattttaaaatatgcagttaagtttttattgactatagtcaccctattgtgctatcatatagtaagttttactcattctttctactttttttgtacccattaacctatccccacctctgccccaccattatctcagctgtctactacttttttcagcctttactaaccatccttctactctatatccatgagttccgttgttttggtttttagatcccacaaataaatgagaacatggcaatgtttgtctttctatgcctggcctatttcacttaacataatgacctccagttccatccatgctgtcgcaagtgacaggatctcattctcttttatggctgaagagtactccattttgtatgtgaaccacattttcttcattcatctgttgatgaacacttagggtgtttccaaatcttagctgttataaacagtattgcaacaaataaaagagtgcagatgg

SEQ ID NO: 122122 - DNA, 501 bp, Homo sapiens
  Payload ID: 3940
  Gene Symbol: CNTNAP3B
  Gene Name: contactin associated protein-like 3B
  ENST ID: ENST00000489789
  CDS Start-End: 1-501
acagcgcggcgcccggactcacgaggactagtgacacaatagtcctttcccaaaaggagcacctcccagtcactcagattgtgatgacagacacaggccaaccacattccgaagcagattatacactggggccactgctctgccgcggagatacaagacttctgaaagtatggagaagagaaagtgtgatatttgaaatattcccttctctttttgggagactgagatgggaggatggcttgagccaaggagttcaacacaagcccggacaagatgagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaag

SEQ ID NO: 122123 - DNA, 4867 bp, Homo sapiens
  Payload ID: 3941
  Gene Symbol: CNTNAP4
  Gene Name: contactin associated protein-like 4
  ENST ID: ENST00000307431
  CDS Start-End: 386-4312
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgatttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg

SEQ ID NO: 122124 - DNA, 4355 bp, Homo sapiens
  Payload ID: 3941
  Gene Symbol: CNTNAP4
  Gene Name: contactin associated protein-like 4
  ENST ID: ENST00000476707
  CDS Start-End: 140-4075
tatataattttatgatttttaaagtattttcatattctcctgtctttaagttttttcttttctcattgaacttactagacttctagtaagccctggaagtagtaggcatatttttagagatcttagatcctagtttttgatgttgttgttttacttgttggttgttttgtctattgattccacgaaagcctcagcactaactaaccctaacgtggcattgttcctcctggcagatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttt

SEQ ID NO: 122125 - DNA, 3708 bp, Homo sapiens
  Payload ID: 3941
  Gene Symbol: CNTNAP4
  Gene Name: contactin associated protein-like 4
  Uniprot ID: Q9C0A0
  ENST ID: ENST00000478060
  CDS Start-End: 1-3708
atgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctga

SEQ ID NO: 122126 - DNA, 4723 bp, Homo sapiens
  Payload ID: 3941
  Gene Symbol: CNTNAP4
  Gene Name: contactin associated protein-like 4
  ENST ID: ENST00000377504
  CDS Start-End: 386-4168
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggtgatttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg

SEQ ID NO: 122127 - DNA, 3783 bp, Homo sapiens
  Payload ID: 3941
  Gene Symbol: CNTNAP4
  Gene Name: contactin associated protein-like 4
  ENST ID: ENST00000622250
  CDS Start-End: 1-3783
atgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctga

SEQ ID NO: 122128 - DNA, 4867 bp, Homo sapiens
  Payload ID: 3941
  Gene Symbol: CNTNAP4
  Gene Name: contactin associated protein-like 4
  Uniprot ID: Q9C0A0
  ENST ID: ENST00000611870
  CDS Start-End: 386-4312
gcggagctcgagcgctgttgtgtgtttggaaggaaggatgctgctgccaatttgtgggaccgctgctgcgaggagtgggcgtggcctcggcggtgtggatgcttgttaggaaagatgctgagtgcttttcagtgaggagtcagggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacgggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccagggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggatactgcactggcaggtgcgcagggcttcacaggctgcctctctgcagtgcagctcagccacgtggcccctctgaaggcagctctgcaccccagccacccagaccctgtcactgttacaggacacgtgactgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttgagaacatttgctgtgtttgcttttgtctcctcgtggtgttattcatagacctggaaatgcttctcagatcctgtgtggccggtgtttgcatcttcagtggccacaagcataataaagcccctttgcctttctctgtattatattcaatacaatacatcaatagtcttgaaaaatg

SEQ ID NO: 122129 - DNA, 5284 bp, Homo sapiens
  Payload ID: 3942
  Gene Symbol: CNTNAP5
  Gene Name: contactin associated protein-like 5
  Uniprot ID: Q8WYK1
  ENST ID: ENST00000431078
  CDS Start-End: 365-4285
gattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactacaactgtgatgatccactagcatccctgctctctccaatggctttttccagttcctcagacctcactggcactcacagcccagctcaactcaactggagagttggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctggacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctataaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgagcttagttttggaggaattccagtaccaggaaaacctgggacctttttaaagaaaaacttccatggatgcatcgaaaacctttactacaatggagtaaacataattgacctggctaagagacgaaagcatcagatctatactggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtgtttgccaaactactgtgaacatggaggaagctgctcccagtcctggactaccttctattgtaactgcagtgacacaagttacactggtgccacctgccacaactccatctacgagcaatcctgcgaggtgtacaggcaccaggggaatacagccggcttcttctacatcgactcagatggcagcggcccactgggacctctccaggtgtactgcaatatcactgaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccggatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggacaaatgatactggctttctttccttcaaagaccacttgcctgtcactcagatagttatcactgataccgacagatcaaactcagaagccgcttggagaattggtcccttgcgttgctatggtgaccgacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggaagcttacaggttcgctatcacctaaacaaggaagaaacccatgtattcaccattgatgcagataactttgctaacagaaggatgcaccacttgaagattaaccgagagggaagagagcttaccattcagatggaccagcaacttcgactcagttataacttctctccggaagtagagttcagggttataaggtcactcaccttgggcaaagtcacagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcagatccttttgggaagacagatgagcgggaaccactcacaaatgctgttcgaagtgattcggcagtcatcggaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaaa

SEQ ID NO: 122130 - DNA, 968 bp, Homo sapiens
  Payload ID: 3943
  Gene Symbol: COPRS
  Gene Name: coordinator of PRMT5, differentiation stimulator
  Uniprot ID: Q9NQ92
  ENST ID: ENST00000302362
  CDS Start-End: 139-693
gcgccccgccctcttggccggtacccaccccctccccaggctgattggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccagtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaaccagtat

SEQ ID NO: 122131 - DNA, 1041 bp, Homo sapiens
  Payload ID: 3943
  Gene Symbol: COPRS
  Gene Name: coordinator of PRMT5, differentiation stimulator
  ENST ID: ENST00000378634
  CDS Start-End: 255-773
aacagccagccgcagcctggggcgggaagtcgcggggccgggctgggcgggggccgcggggccggggaagcgcctctggccggcctcgggccgccccgcgacacggagcgctgtttgggctcgcgctcgagctgaaaacggccaggccgcggggccgcggggctgcggggcggggaaagccgagggcgtgggtgggcgctctgggtcagcagagacggctgtccgcccgctgggcgccgctgcggatttggtaaatgggaggtgacgctggtgaccgagagccggggcccgctgccaggagcctgggcgagggccaggctggctttgctacagctgaccactccagtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 122132 - DNA, 1062 bp, Homo sapiens
  Payload ID: 3943
  Gene Symbol: COPRS
  Gene Name: coordinator of PRMT5, differentiation stimulator
  ENST ID: ENST00000496655
  CDS Start-End: 93-341
ggcgcttctgcggcggatcctcgggcgggcagccgggccggcgcgtcacgtggcccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccagtcaggagagagagactgagaaggctatggatcgactagccagtcctctctgctgcttagtggccttctctgcccagttgaacagtaacctcctttggaagccttgcttggagcttccttaagggaagtcctgaacttttcttatgttcaaatccatccttctaccgagagaaacagcttgaaacgcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaagagaaa

SEQ ID NO: 122133 - DNA, 471 bp, Homo sapiens
  Payload ID: 3943
  Gene Symbol: COPRS
  Gene Name: coordinator of PRMT5, differentiation stimulator
  ENST ID: ENST00000579741
  CDS Start-End: 162-471
aggccgcggggccgcggggctgcggggcggggaaagccgagggcgtgggtgggcgctctgggtcagcagagacggctgtccgcccgctgggcgccgctgcggatttggctggctttgctacagctgaccactccagtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatct

SEQ ID NO: 122134 - DNA, 422 bp, Homo sapiens
  Payload ID: 3943
  Gene Symbol: COPRS
  Gene Name: coordinator of PRMT5, differentiation stimulator
  ENST ID: ENST00000579984
  CDS Start-End: 15-221
gcgggccgcagggcatggaccttcaggccgccggggcccaggcgcagggggccgcggagccgtctcggggcccgccgctgcctagcgcgcggggggcgccccccagcccggagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagct

SEQ ID NO: 122135 - DNA, 2036 bp, Homo sapiens
  Payload ID: 3944
  Gene Symbol: COPS2
  Gene Name: COP9 signalosome subunit 2
  Uniprot ID: P61201
  ENST ID: ENST00000299259
  CDS Start-End: 84-1436
aagaagctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagaattctgattttttatgtcagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaa

SEQ ID NO: 122136 - DNA, 6628 bp, Homo sapiens
  Payload ID: 3944
  Gene Symbol: COPS2
  Gene Name: COP9 signalosome subunit 2
  Uniprot ID: P61201
  ENST ID: ENST00000388901
  CDS Start-End: 75-1406
agagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacattgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactacaagagctggatttccattactcactcttgctcttacattaaagttgttgattaaatactttttctctacatcttaatgtaacataactgatttctttttaaagatgagtatatatgtactaagtaatgctctcattacatgagtcccttctaactacaggctgatacatctttcaggaaaactgagaacctaatatttaagtgaggcctattttaaatgagctatactgtgggtggtagtgtttgttaccttatgtaagacttaggtttgtcttagactgaaaaactcttattcttaatatttaaaatatccatgatggtagaaattttgtgggaaattttcttttttaatcaatagttacagttcttcagtaaacacaggtatgtatgcttttgtggtgtcagtgtcagtctaaatctatgggtgaagcagttagtccataagacaaaaaattatttgcctagtggattccctttacctctttttaagaagctcagagatctgtaatcattaatttactaaggattttttaaaatattattttagtcacttttaaacctgaaaatttctcttttgatttagatttttgaagtgaggcttgagcatacacaagtaaagctgggagtttcattcttcatatgggatttatgactaaatatttctagcattttgaagaagataaacattttgaactgaagtatataacaaaaaaaggaatttgacatttaactattttgtatcaaagtgtttaagaacactatccagaacaagagatggagtatcaggtttcagaatgtgacgcaaaaggcatttggtcttcatttatgtgaccacaattaaaattttcctctttttttctttttctggaggttttcttttagttttcattgttttaggtttttttttcccccaaatcagcatcctatttatatttgtttgatacggtttttttgtttttgtttttgttttgctttttttggaaacagtttcgctcttgtcacccaggctggagtgcagtggcgcaatctcagttcactgccacctccacctcccgggttcaagcgattctcctgcctcaatctccggagtagctgggattacagacacccgccaccacgcccagctaatttttgtgtttttagtagagacaagatttcaccatgttggccaggctggtctcaaactcctgacctcaggcgatccaccgctttggcctcccatagtgctgggattacaggcgtgagccaccacgcccagcctgatacagttttaagcaggaatttggcagaaatttcgtaacgaagacaaattggaggttctctttaactcgagattattaaatttatagtaacttcttgggccattaaaatgtgagtttaaatgccatttggaggatttgtgttatattaagcaccacaaatttaaactgtcaactagtgattctacatgtttctcaaaatgctaaagtttagcatcacttacttgcttttgaattttaaggagattcgtcttaggtaatgtctcagaagaaaccagtgtgtggttctctaaaattttacttttttactgtcacgtataataatatctaaactacctgtagtagttaaaaatattacggcatcaaaggtatatgccaagtgtaccttaaaaccctgtgacaggaaaaaagaaaaaattatttcttaagtacttactattcgggggcaactttgttccgtgttggcaaaattatgaactttgctcagaatttccacatgaatagctgaccaaaacttttttgtgtgcatatgtatacatatgtaataagtgaaacatacttgtgggagtacaaaattcatcaccagtttatcacagtaattttccagttttctattttacttaatatcacttatttctgacacaggcaaatgtcatatgccatgaaaagaattaccagtgtaccagtaacttgcgtgttatgactaggtttcatgtggaagactgtccaaatttacataatctagagtaattttttaattctgaagtaagggcattttaaaattaattgctaaaggttgttttattgtacatccattttatgggagtttagagtttagaaaaagtaatctctagcgtcatcccatgaagttgtcaaaagttttggcatgcttattagcaacatattaatgccaagtgttgagtatctaatttctgttcaaatgtttgcctatcccttactgtttacgacagtaataaatttttatgcatctattttaaataacactgaagaaaattaaaatatatttcaagaaatggagcaatgacatggaaaatagaaagttgtttggttttgcaatgtgttacataattggttgcattataaattttctccattttgtttatgataagctaatataaaaggtatcaaattccttgagctaacactaggtgggaaggaagtagtaggtgattaggaatgtaacaggatgtctgcctgaaatggtcagttccaccaattaataattgagaactgattatatgtgcaggatgtgtcataagatgctgtaaggcttaaatactcaagggtttttttatttatctggaagtgcacattccttattggtaataaaaaatacgtaatct

SEQ ID NO: 122137 - DNA, 1580 bp, Homo sapiens
  Payload ID: 3944
  Gene Symbol: COPS2
  Gene Name: COP9 signalosome subunit 2
  ENST ID: ENST00000542928
  CDS Start-End: 27-1166
aatttctcctccccctcccggccaagatgtctgacatggaggatgatttcatgtgcgatgatgaggaggactacgacctgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttg

SEQ ID NO: 122138 - DNA, 803 bp, Homo sapiens
  Payload ID: 3944
  Gene Symbol: COPS2
  Gene Name: COP9 signalosome subunit 2
  ENST ID: ENST00000558843
  CDS Start-End: 13-803
ctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaa

SEQ ID NO: 122139 - DNA, 575 bp, Homo sapiens
  Payload ID: 3944
  Gene Symbol: COPS2
  Gene Name: COP9 signalosome subunit 2
  ENST ID: ENST00000561248
  CDS Start-End: 27-575
aatttctcctccccctcccggccaagatgtctgacatggaggatgatttcatgtgcgatgatgaggaggactacgacctgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagg

SEQ ID NO: 122140 - DNA, 514 bp, Homo sapiens
  Payload ID: 3944
  Gene Symbol: COPS2
  Gene Name: COP9 signalosome subunit 2
  ENST ID: ENST00000560240
  CDS Start-End: 1-168
aaaacaaatcacagcaacatcatggatgatcctttcataagagaacacattgaagagcttttgcgaaacatcagaacacaagtgcttataaaattaattaagccttacacaagaatacatattccttttatttctaagatggagtctcgctcttgttgcctaggctgaagtgcagtggcacgatctcggctcactgcagcctccgcctcccgggttcaagcgattctcctgcctcagcctcccaagtggctggaattacagagaaaggagaggaagatttggacacagacacacagagaagaggtcaaagtgaagacagaaccagagattggagttttgctgccataagccaagaaaccaagagccaagaaacaccagaaggtaggagaaaggcaaggaagaacttcccctctaaagccttcaaagaaagaaaatataaccctgccagcaccttgatttcagacttctggctccagaactgtgagagaataaatttctgttgttttaagctacc

SEQ ID NO: 122141 - DNA, 1641 bp, Homo sapiens
  Payload ID: 3945
  Gene Symbol: COPS3
  Gene Name: COP9 signalosome subunit 3
  Uniprot ID: Q9UNS2
  ENST ID: ENST00000268717
  CDS Start-End: 108-1379
tcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgtttta

SEQ ID NO: 122142 - DNA, 1009 bp, Homo sapiens
  Payload ID: 3945
  Gene Symbol: COPS3
  Gene Name: COP9 signalosome subunit 3
  ENST ID: ENST00000417352
  CDS Start-End: 54-1009
cagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagagacagagtctcgctatgttggccaggttggtgttgaactcctggcctcaagcagtccttctgcgtctgcctcccagagtgctgggattacagcctcttagcaatgcataccacgagttagcacaagtgtattcaaccaacaacccctcagaactccgaaacctggtgaataagcacagtgaaaccttcactcg

SEQ ID NO: 122143 - DNA, 1394 bp, Homo sapiens
  Payload ID: 3945
  Gene Symbol: COPS3
  Gene Name: COP9 signalosome subunit 3
  ENST ID: ENST00000439936
  CDS Start-End: 133-1170
gcgagtccgttctgggtgtcttggctctatggctcgcctctgccagctcctccgctgccaggcggcgcacgctcgggaacctgtgcgcctattttggtcctacagaatgctgcggaagctctcgctcggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctca

SEQ ID NO: 122144 - DNA, 1699 bp, Homo sapiens
  Payload ID: 3945
  Gene Symbol: COPS3
  Gene Name: COP9 signalosome subunit 3
  Uniprot ID: Q9UNS2
  ENST ID: ENST00000539941
  CDS Start-End: 210-1421
ggtgattggcgcaccgccatgtcatctttgccgccgatccgcagcttgctgactaggccgccgggagcgggcgggaggcgagtccgttctgggtgtcttggctctatggctcgcctctgccagctcctccgctgccaggcggcgcacgctcgggaacctgtgcgcctattttggtcctacagaatgctgcggaagctctcgctcggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagttgcttgaacatta

SEQ ID NO: 122145 - DNA, 876 bp, Homo sapiens
  Payload ID: 3945
  Gene Symbol: COPS3
  Gene Name: COP9 signalosome subunit 3
  ENST ID: ENST00000584216
  CDS Start-End: 88-411
aggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaa

SEQ ID NO: 122146 - DNA, 656 bp, Homo sapiens
  Payload ID: 3945
  Gene Symbol: COPS3
  Gene Name: COP9 signalosome subunit 3
  ENST ID: ENST00000477299
  CDS Start-End: 61-411
agagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagtgacaacataagatccaatgtgctgccatctttgagaacttatctgaaagagatgtcatttctgacagcccctgcgaggaattggcatccttaagcaagccatagacaagatgcagatgaatacaaaccagctgacctcaatacatgctgatctctgccaggctataactactcctgccatggcggtcagtcatatcatgttggaatcatataaaaagtatattttagtgtctttgatattacttggc

SEQ ID NO: 122147 - DNA, 752 bp, Homo sapiens
  Payload ID: 3945
  Gene Symbol: COPS3
  Gene Name: COP9 signalosome subunit 3
  ENST ID: ENST00000577210
  CDS Start-End: 1-63
atggcgtctgccctggagcagttcgtgaacagtgtccgacagctctcagctcaaggtttgtgaagttttctatgcccagtgttcctgacttcgaaacgctattctcacaggttcagctcttcatcagcacttgtaatggggagcacattcgatatgcaacagacacttcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaac

SEQ ID NO: 122148 - DNA, 809 bp, Homo sapiens
  Payload ID: 3945
  Gene Symbol: COPS3
  Gene Name: COP9 signalosome subunit 3
  ENST ID: ENST00000492672
  CDS Start-End: 61-156
agagcggcagccttttcccgcgcgtgctgccttcgccgctcgggccgcccgggggaaaacatggcgtctgccctggagcagttcgtgaacagtgtccgacagctctcagctcaagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaat

SEQ ID NO: 122149 - DNA, 639 bp, Homo sapiens
  Payload ID: 3945
  Gene Symbol: COPS3
  Gene Name: COP9 signalosome subunit 3
  ENST ID: ENST00000577246
  CDS Start-End: 88-150
aggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaaggtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtata

SEQ ID NO: 122150 - DNA, 1625 bp, Homo sapiens
  Payload ID: 3945
  Gene Symbol: COPS3
  Gene Name: COP9 signalosome subunit 3
  ENST ID: ENST00000578317
  CDS Start-End: 6-101
aaaacatggcgtctgccctggagcagttcgtgaacagtgtccgacagctctcagctcaagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagtgacaacataagatccaatgtgctgccatctttgagaacttatctgaaagagatgtcatttctgacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgtttt

SEQ ID NO: 122151 - DNA, 333 bp, Homo sapiens
  Payload ID: 3945
  Gene Symbol: COPS3
  Gene Name: COP9 signalosome subunit 3
  ENST ID: ENST00000495640
  CDS Start-End: 1-53
ttgctgggctttgccatcagctaacaaatgcacttgtggaaagaaaacagtgacaacataagatccaatgtgctgccatctttgagaacttatctgaaagagatgtcatttctgacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatgg

SEQ ID NO: 122152 - DNA, 419 bp, Homo sapiens
  Payload ID: 3945
  Gene Symbol: COPS3
  Gene Name: COP9 signalosome subunit 3
  ENST ID: ENST00000579716
  CDS Start-End: 1-156
gagatttttgcaagtattaaccagaaggacggtatggtcagtttccatgataaccctgaaaaatataataacccagccatgcttcataacattgatcaggagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaa

SEQ ID NO: 122153 - DNA, 365 bp, Homo sapiens
  Payload ID: 3945
  Gene Symbol: COPS3
  Gene Name: COP9 signalosome subunit 3
  ENST ID: ENST00000583160
  CDS Start-End: 1-365
acttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccaggctataactactcctgccatggcggtcagtcatatcatgttggaatcatataaaaagtatattttagtgtctttgatattacttggcaaagtacaacagctaccaaaatatacatctcaaattgtgggtagattcattaag

SEQ ID NO: 122154 - DNA, 1744 bp, Homo sapiens
  Payload ID: 3946
  Gene Symbol: COPS4
  Gene Name: COP9 signalosome subunit 4
  Uniprot ID: Q9BT78
  ENST ID: ENST00000264389
  CDS Start-End: 136-1356
acacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagtta

SEQ ID NO: 122155 - DNA, 1695 bp, Homo sapiens
  Payload ID: 3946
  Gene Symbol: COPS4
  Gene Name: COP9 signalosome subunit 4
  ENST ID: ENST00000511653
  CDS Start-End: 1-1263
atggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacttctggcaaccaccaatccatcttctgtctctggatttacctagtctggatagttcatataaatggaatcatacaatatgtgacatgtgaccttttggctgattccactcagcatagtatctttagggttcatccatgtcatggcagcacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaa

SEQ ID NO: 122156 - DNA, 1702 bp, Homo sapiens
  Payload ID: 3946
  Gene Symbol: COPS4
  Gene Name: COP9 signalosome subunit 4
  ENST ID: ENST00000503682
  CDS Start-End: 19-1335
cgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatgagacaggatctctccattttgcccaggctggtcttgaactcctgggctcaagcagttcctcccatcttggcttcccaaagtgctgggatgataggggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaa

SEQ ID NO: 122157 - DNA, 878 bp, Homo sapiens
  Payload ID: 3946
  Gene Symbol: COPS4
  Gene Name: COP9 signalosome subunit 4
  ENST ID: ENST00000509317
  CDS Start-End: 53-878
tttctttttggctgccagaggcccccgcatccaccgctgagctgggagaaagatggcggcagccgtgcgacaggatttggcccagctcatgaattcgagcggctctcataaagatctggctggcaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaa

SEQ ID NO: 122158 - DNA, 2273 bp, Homo sapiens
  Payload ID: 3946
  Gene Symbol: COPS4
  Gene Name: COP9 signalosome subunit 4
  Uniprot ID: Q9BT78
  ENST ID: ENST00000509093
  CDS Start-End: 779-1837
attctcctgcctcagcctcccgagttgctgggactacaggggtgcaccacctacgcccggctaatttttttgtatttttagtagagaacggggtttcaccgtgttagccaggatggcctcgatctcttgacctcgtgatccgcccgcctcggctgcccaaagtgctgggattacaggcgtgagccaccgcgcccggccgaaaggggggatattaatcattactccaggacgacagagggaaaatcgctttgtactggacaaactggaatgtctgaccaaccattataaagtgcacggagtgggaggaggaatagggacattttaattgtatttctaaaaagtatcttctgtggtgaatcggaaacaaaactcattctttaccacaggcagtttaagcgctgcctgaaagatcgaaggacggtaaaccacagacgtgagaaacggaactttgcgaaaacgcagtcgttttatgtaccggctactcattggagttacaccagagactcactactggagttcatcagccaatccaaagtccaagcgtgagagccagagcctgtaggagagacctgggcaggcctcagacctgaggagtggagctccgcatcactcaaccctgggggcggagctagcccaggctcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaagcacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagcc

SEQ ID NO: 122159 - DNA, 438 bp, Homo sapiens
  Payload ID: 3946
  Gene Symbol: COPS4
  Gene Name: COP9 signalosome subunit 4
  ENST ID: ENST00000507376
  CDS Start-End: 25-180
atccaccgctgagctgggagaaagatggcggcagccgtgcgacaggatttggcccagctcatgaattcgagcggctctcataaagatctggctggcaaaacattattttcatttggtattgttgtaggtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgg

SEQ ID NO: 122160 - DNA, 1480 bp, Homo sapiens
  Payload ID: 3947
  Gene Symbol: COPS5
  Gene Name: COP9 signalosome subunit 5
  Uniprot ID: Q92905
  ENST ID: ENST00000357849
  CDS Start-End: 322-1326
ctcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 122161 - DNA, 1451 bp, Homo sapiens
  Payload ID: 3947
  Gene Symbol: COPS5
  Gene Name: COP9 signalosome subunit 5
  ENST ID: ENST00000518374
  CDS Start-End: 247-453
ataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggataaagggagaagccaagatttcgattcatgtcttgacttccaacatgagtcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatg

SEQ ID NO: 122162 - DNA, 1086 bp, Homo sapiens
  Payload ID: 3947
  Gene Symbol: COPS5
  Gene Name: COP9 signalosome subunit 5
  ENST ID: ENST00000523890
  CDS Start-End: 34-207
tgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggaaaatgggtcctcgctgtgttgctcaggctgatctcgagcttctgccttcaagcgatcctcccgccttcgccttccaaagtgctgggattacaggcgtgaggcctgggcctataatagttttttgattgctgtcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacaggt

SEQ ID NO: 122163 - DNA, 474 bp, Homo sapiens
  Payload ID: 3947
  Gene Symbol: COPS5
  Gene Name: COP9 signalosome subunit 5
  ENST ID: ENST00000517406
  CDS Start-End: 77-313
ccaacttcacctccggttctaggtgtcatggctgccccaagagtctagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggataaagggagaagccaagatttcgattcatgtcttgacttccaacatgaggtctacacatttttcagcttttggttgaaatctggcaaagcttaggaattaaatttggattctttctgtgggcagacatctaaaaaggctttgtagagacgttgactgactgctctgtaaggctgcttaagttgcttggttatctgcttgcttctgtaacaggctgtgcattttagtcaccattactttaagtactgcaaaatctc

SEQ ID NO: 122164 - DNA, 676 bp, Homo sapiens
  Payload ID: 3947
  Gene Symbol: COPS5
  Gene Name: COP9 signalosome subunit 5
  ENST ID: ENST00000518747
  CDS Start-End: 224-676
cctggaggccgcatagctgcccgctgctctcggttcgccagtacgctggccggggacttggtcaactcgttctcctgctgtgcccaggggctattaaactgtgggggccacttctcaggctaaatctattgcagcctctccagcctcccatgcaccagccagcttaggaacagttcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggt

SEQ ID NO: 122165 - DNA, 1621 bp, Homo sapiens
  Payload ID: 3947
  Gene Symbol: COPS5
  Gene Name: COP9 signalosome subunit 5
  ENST ID: ENST00000517736
  CDS Start-End: 563-1156
aacaacaccgcgggcagcagcgaccgcagtggcccaggaatccggaccgtgtaaccagggaacctccccgaccccggcagctgcaagacccctgctcacagaactcccgcccccaaccctcataactcgtagtcaccgatgccggcctcacggcggcgaaatcccaactctccacacccttaactcgggcacctcccccaccgcacccagccgccacgagaccccctgccgacaagaaaccccacccccacccccagattccagagcctgtaactctggcacgtcgccggcctagttgcctcgagacctacgccccgagggagccactgcccctgcccccgctccggggcagcgaatgcagccccaggaccctccaccctcaacctacaccaccccaggccacacctcgccactcacgctccccatccgcggctggctgactcttactcaggggagcgggctcgcgtccggggagacacacagtgctctagaggatcgtcgcggaccgaagagtcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaggcaagtatattaatagcagccagaagtgacacctgatggcaaggggagaaaacactgttaagaccagaacagtctgaacctttgtatgagaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 122166 - DNA, 1432 bp, Homo sapiens
  Payload ID: 3948
  Gene Symbol: COPS6
  Gene Name: COP9 signalosome subunit 6
  Uniprot ID: Q7L5N1
  ENST ID: ENST00000303904
  CDS Start-End: 38-1021
gaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactactttcctgagctaaa

SEQ ID NO: 122167 - DNA, 218 bp, Homo sapiens
  Payload ID: 3948
  Gene Symbol: COPS6
  Gene Name: COP9 signalosome subunit 6
  ENST ID: ENST00000419210
  CDS Start-End: 94-218
ggcgggcgcggggaaaatggcggcggcggcggcggcggctgcagctacgaacgggaccggaggaagcagcgggatggagtagtccccagcgtgatggcctgcggagtgactgggagtgtttccgtcgctctccatccccttgtcattctcaacatctcagaccactggatccgcatgcgctcccaggaggggcggcctgtgcaggtgattggggctct

SEQ ID NO: 122168 - DNA, 1107 bp, Homo sapiens
  Payload ID: 3948
  Gene Symbol: COPS6
  Gene Name: COP9 signalosome subunit 6
  ENST ID: ENST00000418625
  CDS Start-End: 11-991
cgcggggaaaatggcggcggcggcggcggcggctgcagctacgaacgggaccggaggaagcagcgggatggaggtggatgcagcagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagca

SEQ ID NO: 122169 - DNA, 716 bp, Homo sapiens
  Payload ID: 3948
  Gene Symbol: COPS6
  Gene Name: COP9 signalosome subunit 6
  ENST ID: ENST00000426712
  CDS Start-End: 1-372
ctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacc

SEQ ID NO: 122170 - DNA, 1721 bp, Homo sapiens
  Payload ID: 3949
  Gene Symbol: COPS7A
  Gene Name: COP9 signalosome subunit 7A
  Uniprot ID: Q9UBW8
  ENST ID: ENST00000229251
  CDS Start-End: 126-953
ggtggcaggaaaggcttggaacagctgccggaggtgacggagcggcggccccgcccggtgcgctggaggtcgaagcttccagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatat

SEQ ID NO: 122171 - DNA, 1718 bp, Homo sapiens
  Payload ID: 3949
  Gene Symbol: COPS7A
  Gene Name: COP9 signalosome subunit 7A
  ENST ID: ENST00000455113
  CDS Start-End: 185-373
agagtttagtggccagagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatat

SEQ ID NO: 122172 - DNA, 2127 bp, Homo sapiens
  Payload ID: 3949
  Gene Symbol: COPS7A
  Gene Name: COP9 signalosome subunit 7A
  Uniprot ID: Q9UBW8
  ENST ID: ENST00000543155
  CDS Start-End: 483-1310
aggtacccagtgcagtcctgatctccagctctccagcggcttagaacagacacagaatgggccgggaccagggacccaccagagacgtctgtagttaatagctggcgctcttccactaataaagttttattgaaataaagcatttaaaaaggcgcccgtcattcttcccccagcgaccaatcgaagagtagaatgcctgcgtccctcactggagcttcagcggtcggaacgcgggggtggggcatgtcctgccgaaatttgcgtccttagagcggaagtacggccggaagcccgccatagagtttagtggccagagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatct

SEQ ID NO: 122173 - DNA, 898 bp, Homo sapiens
  Payload ID: 3949
  Gene Symbol: COPS7A
  Gene Name: COP9 signalosome subunit 7A
  ENST ID: ENST00000538375
  CDS Start-End: 89-277
ggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttag

SEQ ID NO: 122174 - DNA, 1707 bp, Homo sapiens
  Payload ID: 3949
  Gene Symbol: COPS7A
  Gene Name: COP9 signalosome subunit 7A
  Uniprot ID: Q9UBW8
  ENST ID: ENST00000534877
  CDS Start-End: 77-904
gcagcaatggagagctgagggagcgtcgtcaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaa

SEQ ID NO: 122175 - DNA, 569 bp, Homo sapiens
  Payload ID: 3949
  Gene Symbol: COPS7A
  Gene Name: COP9 signalosome subunit 7A
  ENST ID: ENST00000540408
  CDS Start-End: 205-393
aacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccag

SEQ ID NO: 122176 - DNA, 802 bp, Homo sapiens
  Payload ID: 3949
  Gene Symbol: COPS7A
  Gene Name: COP9 signalosome subunit 7A
  ENST ID: ENST00000543537
  CDS Start-End: 107-295
ggagagctgagggagcgtcgtcagggtggacaccatgcgacacccatttctcctttgcatcctctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaag

SEQ ID NO: 122177 - DNA, 1610 bp, Homo sapiens
  Payload ID: 3949
  Gene Symbol: COPS7A
  Gene Name: COP9 signalosome subunit 7A
  ENST ID: ENST00000538410
  CDS Start-End: 142-930
aggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacg

SEQ ID NO: 122178 - DNA, 502 bp, Homo sapiens
  Payload ID: 3949
  Gene Symbol: COPS7A
  Gene Name: COP9 signalosome subunit 7A
  ENST ID: ENST00000544725
  CDS Start-End: 127-502
gacgaagcagtcggcgggagcccacggtcgctgggcggtgtctttaagggagggggcggagccacgtgtaagcttcaatggggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgc

SEQ ID NO: 122179 - DNA, 1728 bp, Homo sapiens
  Payload ID: 3949
  Gene Symbol: COPS7A
  Gene Name: COP9 signalosome subunit 7A
  ENST ID: ENST00000543939
  CDS Start-End: 192-380
ccccgcccggtgcgctggaggtcgaagcttccaggtagcggcccgcagagcctgacccagggtacgacgaagcagtcggcgggagcccacggtcgctgggcggtgtctttaagggagggggcggagccacgtgtaagcttcaatggggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatata

SEQ ID NO: 122180 - DNA, 754 bp, Homo sapiens
  Payload ID: 3949
  Gene Symbol: COPS7A
  Gene Name: COP9 signalosome subunit 7A
  ENST ID: ENST00000538753
  CDS Start-End: 117-754
ggagagctgagggagcgtcgtcagggtggacaccatgcgacacccatttctcctttgcatcctgtgtcttgggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggt

SEQ ID NO: 122181 - DNA, 744 bp, Homo sapiens
  Payload ID: 3949
  Gene Symbol: COPS7A
  Gene Name: COP9 signalosome subunit 7A
  ENST ID: ENST00000546229
  CDS Start-End: 82-297
gcggggcagcaatggagagctgagggagcgtcgtcaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagggtaggaattggatgacgtatggagcaagagggcattgtggtttgggagaatagtgtaaacaaaagcctgaaggtggaaatgagcccttcctatgtgaagagtgatcagagaggcagagaactccttttgctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtg

SEQ ID NO: 122182 - DNA, 1832 bp, Homo sapiens
  Payload ID: 3949
  Gene Symbol: COPS7A
  Gene Name: COP9 signalosome subunit 7A
  Uniprot ID: Q9UBW8
  ENST ID: ENST00000539735
  CDS Start-End: 216-1043
gaaaggcttggaacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatat

SEQ ID NO: 122183 - DNA, 940 bp, Homo sapiens
  Payload ID: 3949
  Gene Symbol: COPS7A
  Gene Name: COP9 signalosome subunit 7A
  ENST ID: ENST00000541866
  CDS Start-End: 364-940
cggggcagcaatggagagctgagggagcgtcgtcagggtggacaccatgcgacacccatttctcctttgcatcctgtgtcttggggttcaatggggtgcacgtgatggggcttggggttaggcccaggggagggggtgggtgtggcagccttgcgaagtggctgactttaggattcctagatcagaattttagaccgctccatgtctgattcctcaccgcagaaccgacttagtgcctttacaatccagtccctcagccttgtgcttcccatccgaccagccatcggggacctctagcttcacatcctctttccttgcagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtga

SEQ ID NO: 122184 - DNA, 552 bp, Homo sapiens
  Payload ID: 3949
  Gene Symbol: COPS7A
  Gene Name: COP9 signalosome subunit 7A
  ENST ID: ENST00000543170
  CDS Start-End: 116-304
aaggcttggaacagctgccggaggtgacggagcggcggccccgcccggtgcgctggaggtcgaagcttccagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcc

SEQ ID NO: 122185 - DNA, 534 bp, Homo sapiens
  Payload ID: 3949
  Gene Symbol: COPS7A
  Gene Name: COP9 signalosome subunit 7A
  ENST ID: ENST00000537022
  CDS Start-End: 113-283
agcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagtggaactaaagagtatcaatcaaagtgatgaaaaagaagcacttggctgggtgcggtggctcatgcctgtaatcccagcactttggaaggccaagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaag

SEQ ID NO: 122186 - DNA, 538 bp, Homo sapiens
  Payload ID: 3949
  Gene Symbol: COPS7A
  Gene Name: COP9 signalosome subunit 7A
  ENST ID: ENST00000544316
  CDS Start-End: 221-403
ggcagccttgcgaagtggctgactttaggattcctagatcagaattttagaccgctccatgtctgattcctcaccgcagaaccgacttagtgcctttacaatccagtccctcagccttgtgcttcccatccgaccagccatcggggacctctagcttcacatcctctttccttgcagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagagacacatggcaaactgctaggaacacagcagagagaaccgttcacacaaaagtggcagagttaatttacaatcagaggaggcagcctgagtcctgacatgctgacagtgtggaactaaagagtatcaatcaaagtgatgaaaaagaagcacttgg

SEQ ID NO: 122187 - DNA, 2034 bp, Homo sapiens
  Payload ID: 3949
  Gene Symbol: COPS7A
  Gene Name: COP9 signalosome subunit 7A
  Uniprot ID: Q9UBW8
  ENST ID: ENST00000534947
  CDS Start-End: 371-1198
gcgcgtgcggggcagcaatggagagctgagggagcgtcgtcagggtggacaccatgcgacacccatttctcctttgcatcctgtgtcttggggttcaatggggtgcacgtgatggggcttggggttaggcccaggggagggggtgggtgtggcagccttgcgaagtggctgactttaggattcctagatcagaattttagaccgctccatgtctgattcctcaccgcagaaccgacttagtgcctttacaatccagtccctcagccttgtgcttcccatccgaccagccatcggggacctctagcttcacatcctctttccttgcagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctatctacaaactaccctgaa

SEQ ID NO: 122188 - DNA, 871 bp, Homo sapiens
  Payload ID: 3949
  Gene Symbol: COPS7A
  Gene Name: COP9 signalosome subunit 7A
  ENST ID: ENST00000536872
  CDS Start-End: 367-555
gtgcggggcagcaatggagagctgagggagcgtcgtcagggtggacaccatgcgacacccatttctcctttgcatcctgtgtcttggggttcaatggggtgcacgtgatggggcttggggttaggcccaggggagggggtgggtgtggcagccttgcgaagtggctgactttaggattcctagatcagaattttagaccgctccatgtctgattcctcaccgcagaaccgacttagtgcctttacaatccagtccctcagccttgtgcttcccatccgaccagccatcggggacctctagcttcacatcctctttccttgcagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccg

SEQ ID NO: 122189 - DNA, 1768 bp, Homo sapiens
  Payload ID: 3949
  Gene Symbol: COPS7A
  Gene Name: COP9 signalosome subunit 7A
  ENST ID: ENST00000626119
  CDS Start-End: 183-371
ggaagtacggccggaagcccgccatagagtttagtggccagagcgactcttcagggaggtggcaggaaaggcttggaacagctgccggaggtgacggagcggcggccccgcccggtgcgctggaggtcgaagcttccagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctatctacaaactaccctg

SEQ ID NO: 122190 - DNA, 2544 bp, Homo sapiens
  Payload ID: 3950
  Gene Symbol: COPS7B
  Gene Name: COP9 signalosome subunit 7B
  Uniprot ID: Q9H9Q2
  ENST ID: ENST00000350033
  CDS Start-End: 142-936
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatccca

SEQ ID NO: 122191 - DNA, 2563 bp, Homo sapiens
  Payload ID: 3950
  Gene Symbol: COPS7B
  Gene Name: COP9 signalosome subunit 7B
  Uniprot ID: Q9H9Q2
  ENST ID: ENST00000373608
  CDS Start-End: 108-929
cgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagagagggaaaaacgtgatgtccccctcctgaatcttataacaacagctttcttctggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatccca

SEQ ID NO: 122192 - DNA, 1009 bp, Homo sapiens
  Payload ID: 3950
  Gene Symbol: COPS7B
  Gene Name: COP9 signalosome subunit 7B
  ENST ID: ENST00000409295
  CDS Start-End: 147-839
atcccctgcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctca

SEQ ID NO: 122193 - DNA, 806 bp, Homo sapiens
  Payload ID: 3950
  Gene Symbol: COPS7B
  Gene Name: COP9 signalosome subunit 7B
  Uniprot ID: Q9H9Q2
  ENST ID: ENST00000409091
  CDS Start-End: 283-756
gcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggg

SEQ ID NO: 122194 - DNA, 1103 bp, Homo sapiens
  Payload ID: 3950
  Gene Symbol: COPS7B
  Gene Name: COP9 signalosome subunit 7B
  Uniprot ID: Q9H9Q2
  ENST ID: ENST00000410024
  CDS Start-End: 230-1024
tcccagcatcccctgcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctc

SEQ ID NO: 122195 - DNA, 2051 bp, Homo sapiens
  Payload ID: 3950
  Gene Symbol: COPS7B
  Gene Name: COP9 signalosome subunit 7B
  ENST ID: ENST00000410017
  CDS Start-End: 111-947
ggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagagattgcttgttttcagagggaaaaacgtgatgtccccctcctgaatcttataacaacagctttcttctggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcc

SEQ ID NO: 122196 - DNA, 1935 bp, Homo sapiens
  Payload ID: 3950
  Gene Symbol: COPS7B
  Gene Name: COP9 signalosome subunit 7B
  ENST ID: ENST00000412922
  CDS Start-End: 111-422
ggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggat

SEQ ID NO: 122197 - DNA, 584 bp, Homo sapiens
  Payload ID: 3950
  Gene Symbol: COPS7B
  Gene Name: COP9 signalosome subunit 7B
  ENST ID: ENST00000432387
  CDS Start-End: 120-356
aaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagccaggatggtctcgatctcctgacctcatgatccacccgcctcggcctcccaaagtgctgggattacaggcgtgagccaccgcgcccggcccacgtttgtgatttaaacaacaacaacaacaacaacaaccagttaacgtaattgacagcagagaagttccaggcagaacagtggctctttcgtttttcttctacacatggctttttgccatcagcatcagtgaagacttgcggaaggagctaatgctgcttatttgcagttgttgaacctgtttgcctatgggacatacccagattacatag

SEQ ID NO: 122198 - DNA, 474 bp, Homo sapiens
  Payload ID: 3950
  Gene Symbol: COPS7B
  Gene Name: COP9 signalosome subunit 7B
  ENST ID: ENST00000436564
  CDS Start-End: 1-149
tgtatgtctttggagaacttctggagctggccaacgtgcaggagcttgcggaaggagctaatgctgcttatttgcagttgttgaacctgtttgcctatgggacatacccagattacatagatgagattcttgaggactggtgtttgtagggctcttggagtgctgtgaagtgcagaatacccacctgtagaatgtttcaacattttaaatattatcaaaataataccagcatattgaagaaaatttggaaaatagactttttaaaagtcactcataggctgggcgcggtggctcatgcctgtaatcccagcactttgggaggccgaggcaggcagatcacttgagccaacaaggagagcctgccagaactgagcacagctcagcagaacaagctgaagcatcttaccatcgtgagcttggcatcaagaatgaagtgtatcccctactccgtgttgctgaaagacctggagatgc

SEQ ID NO: 122199 - DNA, 559 bp, Homo sapiens
  Payload ID: 3950
  Gene Symbol: COPS7B
  Gene Name: COP9 signalosome subunit 7B
  ENST ID: ENST00000450501
  CDS Start-End: 121-309
gaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggaggatggtctcgatctcctgacctcatgatccacccgcctcggcctcccaaagtgctgggattacaggcgtgagccaccgcgcccggcccacgtttgtgatttaaacaacaacaacaacaacaacaaccagttaacgtaattgacagcagagaagttccaggcagaacagtggctctttcgtttttcttctacacatggctttttgccatcagcatcagtgaagacttgcggaaggagctaatgctgcttatttgcagttgttgaacctgtttgcctat

SEQ ID NO: 122200 - DNA, 2442 bp, Homo sapiens
  Payload ID: 3950
  Gene Symbol: COPS7B
  Gene Name: COP9 signalosome subunit 7B
  ENST ID: ENST00000413197
  CDS Start-End: 122-310
agaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgc

SEQ ID NO: 122201 - DNA, 978 bp, Homo sapiens
  Payload ID: 3950
  Gene Symbol: COPS7B
  Gene Name: COP9 signalosome subunit 7B
  ENST ID: ENST00000449784
  CDS Start-End: 194-358
agactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagtagagacggggtttcaccttgttagccaggatggtctcgatctcctgacctcatgatccacccgcctcggcctcccaaagtgctgggattacaggcgtgagccaccgcgcccggcccacgtttgtgatttaaacaacaacaacaacaacaacaaccagttaacgtaattgacagcagagaagttccaggcagaacagtggctctttcgtttttcttctacacatggctttttgccatcagcatcagtgaagacttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtg

SEQ ID NO: 122202 - DNA, 600 bp, Homo sapiens
  Payload ID: 3950
  Gene Symbol: COPS7B
  Gene Name: COP9 signalosome subunit 7B
  ENST ID: ENST00000452375
  CDS Start-End: 194-400
agactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagagacggggtttcaccttgttagccaggatggtctcgatctcctgacctcatgatccacccgcctcggcctcccaaagtgctgggattacaggcgtgagccaccgcgcccggcccacgtttgtgatttaaacaacaacaacaacaacaacaaccagttaacgtaattgacagcagagaagttccaggcagaacagtggctctttcgtttttcttctacacatggctttttgccatcagcatcagtg

SEQ ID NO: 122203 - DNA, 668 bp, Homo sapiens
  Payload ID: 3950
  Gene Symbol: COPS7B
  Gene Name: COP9 signalosome subunit 7B
  ENST ID: ENST00000449174
  CDS Start-End: 1-519
tacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtccc

SEQ ID NO: 122204 - DNA, 563 bp, Homo sapiens
  Payload ID: 3950
  Gene Symbol: COPS7B
  Gene Name: COP9 signalosome subunit 7B
  ENST ID: ENST00000357490
  CDS Start-End: 120-284
aaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagtagagacggggtttcaccttgttagccaggatggtctcgatctcctgacctcatgatccacccgcctcggcctcccaaagtgctgggattacaggcgtgagccaccgcgcccggcccacgtttgtgatttaaacaacaacaacaacaacaacaaccagttaacgtaattgacagcagagaagttccaggcagaacagtggctctttcgtttttcttctacacatggctttttgccatcagcatcagtgaagacttgcggaaggagctaatgctgcttatttg

SEQ ID NO: 122205 - DNA, 571 bp, Homo sapiens
  Payload ID: 3950
  Gene Symbol: COPS7B
  Gene Name: COP9 signalosome subunit 7B
  ENST ID: ENST00000412591
  CDS Start-End: 122-571
agaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaact

SEQ ID NO: 122206 - DNA, 2468 bp, Homo sapiens
  Payload ID: 3950
  Gene Symbol: COPS7B
  Gene Name: COP9 signalosome subunit 7B
  ENST ID: ENST00000611614
  CDS Start-End: 230-859
tcccagcatcccctgcactcggttcctctgtaacttagactccagtgtgccgcgcagtgtgcgcaaattcacaaacccgcccgctgagttggtcgtttcggaatcccgagacttgaaacccaacgggaagacccttctcaccctcaaaagaagatgacagcccgcagagagttaacttctgtttacatggaactcagacatctgcaaatcatgatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 122207 - DNA, 2500 bp, Homo sapiens
  Payload ID: 3950
  Gene Symbol: COPS7B
  Gene Name: COP9 signalosome subunit 7B
  Uniprot ID: Q9H9Q2
  ENST ID: ENST00000620578
  CDS Start-End: 418-891
agcggtgggaggcttccgggggagctgcacgggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccat

SEQ ID NO: 122208 - DNA, 189 bp, Homo sapiens
  Payload ID: 3950
  Gene Symbol: COPS7B
  Gene Name: COP9 signalosome subunit 7B
  ENST ID: ENST00000631349
  CDS Start-End: 1-189
atggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggaggatggtctcgatctcctgacctcatga

SEQ ID NO: 122209 - DNA, 4007 bp, Homo sapiens
  Payload ID: 3951
  Gene Symbol: COPS8
  Gene Name: COP9 signalosome subunit 8
  Uniprot ID: Q99627
  ENST ID: ENST00000354371
  CDS Start-End: 654-1283
attccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttcatctaagatagtttctggaaatttcactctcgatctttctgtggacacaatctattttgtcattgtgtctatatgaatctcttaagtagaaatgagttgtatggtgaatctgtgtagtgataattatataatttatttattttgaatgcattttagtggctatttcagtttttcttaacatatatgggaatactttttgaattgcaattttatttaacccggataggtaagtcatattaaaattccttgttttacagttgaggaaatgggaattcaagaagtcagaggatcaggagagtgatcaagagaatgacagtgccagtttttttaacttccaggtattaagtacaaattgtatccatggttattttttaaaagcagattagagtcaatccaaatattcattaataggggattgtttgaataaacagcagtgtagactacgcaggtgtaaaaggagtgaagatctctatactaaactggaatgatctccagagtgagaacatagaaagcacatgtagtttatatggttattttgagggtaacaaaaggagaatgattacaattatatatatgtacatatttccttatatttcaaaactaagcaattgggggatatatacaaaatgaatataatagttccctaaagaggaaggagaggacagtgaactactacatagagaaaaaataatctcaagtgatcaaacacaatatttcaattttacattgtcagtgggatatacactaaggacagaaaaaaatcttagactaatgaatgtggtttttcatgattaatttcacaaaatcttgatatcttttttattattaaaagtatagattaaattaataatcatgtaacattagaccccagtaatcttaaatttgacatggaaacctcattatatgctttatttttctttgtaaacagtaaatatttcccactcctgtctacatgaaaaggtctagagtaattacagttcagtaacaatgagcaccactagtacccagatggtgttctttcattttcatttgcaattaaaaggaatcagaacttatttgcaaaacagctaatagttccagggcagtaagtgtacaagttcatatctggtacaagatgtccaggattcaaggaggctcttaaagacttgggattctgtcaaagggttatacaagccaacttgaagggatttctacaggccatgtaaaaatgagacagtttgagcatgaaatatttgtatatgtgtctgtttttaactcttaataacctcatcactgtacaagaaaggcagggtaagtgcttgatttcacttccctttattatcagttctcaggacaaattgatatgctgccaatctctaaagcaacaaaatcgaacctgtagggtagtcaaaaagctcatgctggaaaattccaccgaataaagataaaagttagaaaaacggtacttgcagcccttaatgaaacaaagaagggatcatggaaatatatatcaatgctgttgagaccacagggtaagaaattgagattgagcatgaaatatgtccagtacatccatcagcctgtctttgtgctctggctatttctgagccagccatctgtgtacaagtgtagcctgacagcaccctgtttcagatccattggatatctctaaaatttgctctgggacttaccctggcactactatcaggatgcccacacaaacctgattgggcagcccatcagcagttgtgaacatgacatggtgaataaacactctcttccttgtc

SEQ ID NO: 122210 - DNA, 1654 bp, Homo sapiens
  Payload ID: 3951
  Gene Symbol: COPS8
  Gene Name: COP9 signalosome subunit 8
  Uniprot ID: Q99627
  ENST ID: ENST00000392008
  CDS Start-End: 296-778
aaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggacgcttgatgtaatgggcagaatcagaatgcttcaggaatctgtcgaatttgtttcttataatagcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgtt

SEQ ID NO: 122211 - DNA, 794 bp, Homo sapiens
  Payload ID: 3951
  Gene Symbol: COPS8
  Gene Name: COP9 signalosome subunit 8
  ENST ID: ENST00000409334
  CDS Start-End: 82-603
acgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgtt

SEQ ID NO: 122212 - DNA, 584 bp, Homo sapiens
  Payload ID: 3951
  Gene Symbol: COPS8
  Gene Name: COP9 signalosome subunit 8
  ENST ID: ENST00000419015
  CDS Start-End: 57-251
gggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacataaacttttatgacctctatttacttaacttcatatataatcaataaaacaaaagaagtgaaaagagaagattgcagccaagaggaattcgttacaaacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaaga

SEQ ID NO: 122213 - DNA, 496 bp, Homo sapiens
  Payload ID: 3951
  Gene Symbol: COPS8
  Gene Name: COP9 signalosome subunit 8
  ENST ID: ENST00000447464
  CDS Start-End: 1-250
aatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatttgaggaaatgggaattcaagaagtcagaggatcaggagagtgatcaagagaatgacagtgccagtttttttaacttccaggtattaagtacaaattgtatccatggttattttttaaaagcagattagagtcaatccaaatattcattaataggggattgtttgaataaacagcagtgtagacta

SEQ ID NO: 122214 - DNA, 588 bp, Homo sapiens
  Payload ID: 3952
  Gene Symbol: CPNE9
  Gene Name: copine family member IX
  ENST ID: ENST00000273027
  CDS Start-End: 1-588
ccagaaccagttcacagtatatgaggttcttaaccctcggaagaaatgtaagaagaagaaatatgtcaactcaggaactgacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagcca

SEQ ID NO: 122215 - DNA, 1751 bp, Homo sapiens
  Payload ID: 3952
  Gene Symbol: CPNE9
  Gene Name: copine family member IX
  Uniprot ID: Q8IYJ1
  ENST ID: ENST00000383831
  CDS Start-End: 172-1683
ggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccgaaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcaggaaggttgctgcagccttggcacatccgtggtgtaggtcgggaggtccccaaggcccctgccctctagtggagacaaccaacaataaataatcacacaaagaaa

SEQ ID NO: 122216 - DNA, 2068 bp, Homo sapiens
  Payload ID: 3952
  Gene Symbol: CPNE9
  Gene Name: copine family member IX
  Uniprot ID: Q8IYJ1
  ENST ID: ENST00000383832
  CDS Start-End: 191-1852
atctggagccgctgccgccggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccgaaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcagttcgtcccattccgagactatgttgaccggtcggggaaccaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagaggcacctggaaccctggacttcactgggagggccaacttggaggatcagtgctggctgacaagccctccgcctccttgcctgcagagggcctggcactatcaccacctctctgccttcatgccaataataaagctgatctttattcca

SEQ ID NO: 122217 - DNA, 1742 bp, Homo sapiens
  Payload ID: 3952
  Gene Symbol: CPNE9
  Gene Name: copine family member IX
  ENST ID: ENST00000613455
  CDS Start-End: 172-1683
ggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccggaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcaggaaggttgctgcagccttggcacatccgtggtgtaggtcgggaggtccccaaggcccctgccctctagtggagacaaccaacaataaataatcac

SEQ ID NO: 122218 - DNA, 1961 bp, Homo sapiens
  Payload ID: 3953
  Gene Symbol: CPNE1
  Gene Name: copine I
  ENST ID: ENST00000317677
  CDS Start-End: 136-1764
caaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 122219 - DNA, 2147 bp, Homo sapiens
  Payload ID: 3953
  Gene Symbol: CPNE1
  Gene Name: copine I
  Uniprot ID: Q99829
  ENST ID: ENST00000352393
  CDS Start-End: 324-1937
cgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaatgctttgccacca

SEQ ID NO: 122220 - DNA, 1695 bp, Homo sapiens
  Payload ID: 3953
  Gene Symbol: CPNE1
  Gene Name: copine I
  ENST ID: ENST00000397442
  CDS Start-End: 75-1520
gtggctgcgttgggctccgggaagccgttcgggctggggctgtcggccgcggggcggaggcactcgcgcgggggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattc

SEQ ID NO: 122221 - DNA, 1928 bp, Homo sapiens
  Payload ID: 3953
  Gene Symbol: CPNE1
  Gene Name: copine I
  Uniprot ID: Q99829
  ENST ID: ENST00000397443
  CDS Start-End: 118-1731
ggtggctgcgttgggctccgggaagccgttcgggctggggctgtcggccgcggggcggaggcactcgcgcggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 122222 - DNA, 1795 bp, Homo sapiens
  Payload ID: 3953
  Gene Symbol: CPNE1
  Gene Name: copine I
  ENST ID: ENST00000401607
  CDS Start-End: 77-1360
tggtggctgcgttgggctccgggaagccgttcgggctggggctgtcggccgcggggcggaggcactcgcgcgggggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcc

SEQ ID NO: 122223 - DNA, 748 bp, Homo sapiens
  Payload ID: 3953
  Gene Symbol: CPNE1
  Gene Name: copine I
  ENST ID: ENST00000439806
  CDS Start-End: 55-748
ggaacgcggagccgctgagcgggccgacggccattttgtgaagcggcgaaggagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttgg

SEQ ID NO: 122224 - DNA, 744 bp, Homo sapiens
  Payload ID: 3953
  Gene Symbol: CPNE1
  Gene Name: copine I
  ENST ID: ENST00000416778
  CDS Start-End: 105-744
ggctccgggaagccgttcgggctggggctgtcggccgcggggcggaggcactcgcgcggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcc

SEQ ID NO: 122225 - DNA, 596 bp, Homo sapiens
  Payload ID: 3953
  Gene Symbol: CPNE1
  Gene Name: copine I
  ENST ID: ENST00000458038
  CDS Start-End: 184-596
cggcgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggacttcctgggaaaatcagatccatttct

SEQ ID NO: 122226 - DNA, 1332 bp, Homo sapiens
  Payload ID: 3953
  Gene Symbol: CPNE1
  Gene Name: copine I
  ENST ID: ENST00000430570
  CDS Start-End: 174-1332
ggaacgcggagccgctgagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactg

SEQ ID NO: 122227 - DNA, 826 bp, Homo sapiens
  Payload ID: 3953
  Gene Symbol: CPNE1
  Gene Name: copine I
  ENST ID: ENST00000437100
  CDS Start-End: 371-826
cattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaag

SEQ ID NO: 122228 - DNA, 731 bp, Homo sapiens
  Payload ID: 3953
  Gene Symbol: CPNE1
  Gene Name: copine I
  ENST ID: ENST00000415920
  CDS Start-End: 1-626
gtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgtgagcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgctcctgacaaccctcattcaataaagaccagtgaagaccaa

SEQ ID NO: 122229 - DNA, 746 bp, Homo sapiens
  Payload ID: 3953
  Gene Symbol: CPNE1
  Gene Name: copine I
  ENST ID: ENST00000440240
  CDS Start-End: 225-746
ggaggtggtggctgcgttgggctccgggaagccgttcgggctggggctgtcggccgcggggcggaggcactcgcgcggggggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctg

SEQ ID NO: 122230 - DNA, 821 bp, Homo sapiens
  Payload ID: 3953
  Gene Symbol: CPNE1
  Gene Name: copine I
  ENST ID: ENST00000420363
  CDS Start-End: 195-821
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccag

SEQ ID NO: 122231 - DNA, 1070 bp, Homo sapiens
  Payload ID: 3953
  Gene Symbol: CPNE1
  Gene Name: copine I
  ENST ID: ENST00000414664
  CDS Start-End: 158-1070
gagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccc

SEQ ID NO: 122232 - DNA, 784 bp, Homo sapiens
  Payload ID: 3953
  Gene Symbol: CPNE1
  Gene Name: copine I
  ENST ID: ENST00000439669
  CDS Start-End: 124-540
ggaggtggtggctgcgttgggctccgggaagccgttcgggctggggctgtcggccgcggggcggaggcactcgcgcggggggtaattcggggtctgggttctggtgccgcgcagctttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacgtctcccctacctaggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatga

SEQ ID NO: 122233 - DNA, 831 bp, Homo sapiens
  Payload ID: 3953
  Gene Symbol: CPNE1
  Gene Name: copine I
  ENST ID: ENST00000434795
  CDS Start-End: 227-831
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgg

SEQ ID NO: 122234 - DNA, 673 bp, Homo sapiens
  Payload ID: 3953
  Gene Symbol: CPNE1
  Gene Name: copine I
  ENST ID: ENST00000414711
  CDS Start-End: 265-673
gctgtcggccgcggggcggaggcactcgcgcgggggtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggaca

SEQ ID NO: 122235 - DNA, 400 bp, Homo sapiens
  Payload ID: 3953
  Gene Symbol: CPNE1
  Gene Name: copine I
  ENST ID: ENST00000435747
  CDS Start-End: 201-400
tgagcctgcgtaccgaagtggggacgaggccatagcgaggactcccccgtggtctgagagggggcaggccagagctggctggctcagcggcctgcgagctaacggggactgcagtaaaaacacgcctacatcccgagtacggaggatttcttgtctcccccagtgaagcagaggttataactacatctctgtgcctggagatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccg

SEQ ID NO: 122236 - DNA, 1755 bp, Homo sapiens
  Payload ID: 3953
  Gene Symbol: CPNE1
  Gene Name: copine I
  ENST ID: ENST00000437340
  CDS Start-End: 156-1755
aaccacgccgttcctcccccttctggaacgcggagccgctgagcgggccgacggccattttgtgaagcggcgaaggaggtggtggctgcgttgggctccgggaagccgttcgggctggggctgtcggccgcggggcggaggcactcgcgcgggggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggtctcagctcaggaattaaaggacaatcgtgtagtaaccatggaggtagaggccagaaacctagataagaaggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggactatgactcagacaagctgttccctgcatttggatttggggcccaggttccccctgactggcaggtctcgcatgaatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgtacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggccc

SEQ ID NO: 122237 - DNA, 998 bp, Homo sapiens
  Payload ID: 3953
  Gene Symbol: CPNE1
  Gene Name: copine I
  ENST ID: ENST00000412056
  CDS Start-End: 83-998
aggaggtggtggctgcgttgggctccgggaagccgttcgggctggggctgtcggccgcggggcggaggcactcgcgcgggggatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacagattgtgtccagccaggtactgactctccccttgatgctgaagcctggaaaacctgctgggcgggggaccatcacggacttcctgggaaaatcagatccatttctggagttcttccgccagggtgatgggaaatggcacctggtgtacagatctgaggtcatcaagaacaacctgaaccctacatggaagcgtttctcagtccccgttcagcatttctgtggtgggaaccccagcacacccatccaggtgcaatgctccgattatgacagtgacgggtcacatgatctcatcggtaccttccacaccagcttggcccagctgcaggcagtcccggctgagtttgaatgcatccaccctgagaagcagcagaaaaagaaaagctacaagaactctggaactatccgtgtcaagatttgtcgggtagaaacagagtactcctttctggactatgtgatgggaggctgtcagatcaacttcactgtgggcgtggacttcactggctccaatggagacccctcctcacctgactccctacactacctgagtccaacaggggtcaatgagtacctgatggcactgtggagtgtgggcagcgtggttcaggact

SEQ ID NO: 122238 - DNA, 2645 bp, Homo sapiens
  Payload ID: 3954
  Gene Symbol: CPNE2
  Gene Name: copine II
  Uniprot ID: Q96FN4
  ENST ID: ENST00000290776
  CDS Start-End: 290-1936
ccctcctcggccggagggaggagcccgagccgccgccgccgccgccgcccgcccgcccggcccgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaatttttacaatcataactggctttttccaagtaactagctgcagactctgatgaaagaaacatgtccttggtgcatacgtgtcgtagcctgcacctaattaattcctgctgtttttttaatactgtgactgtgttctatttgttatatgctcagggtaacaaatgagtttcagacgtccctgcgtcagctccttcctcagcagggacctgacgggctcactgatctaagaaaggaaatggaaaatgaaaatccaccccacaagtctaataagttggtgtagtcacttctgcatggggacatgcattccagatgataacctgttaaatcactgccagttaacagtgataacctgttaaactggcacagaacctggcacattgtacaaactcaataaatattcatggatgaatagaatg

SEQ ID NO: 122239 - DNA, 2316 bp, Homo sapiens
  Payload ID: 3954
  Gene Symbol: CPNE2
  Gene Name: copine II
  Uniprot ID: Q96FN4
  ENST ID: ENST00000535318
  CDS Start-End: 362-2008
ggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgggaacttggcccagaccctccccccctgtggccctctgggtcaccatctgtgaaatgggctgatgttccggggcctgcctcctggagaatggacacagcatgaaggcgtggttttatggcattccgcctggcataggtccagactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaatttttacaatcataa

SEQ ID NO: 122240 - DNA, 936 bp, Homo sapiens
  Payload ID: 3954
  Gene Symbol: CPNE2
  Gene Name: copine II
  ENST ID: ENST00000567487
  CDS Start-End: 573-936
tttgaaaaagggttttcccaaaataaaaagtgaaaaccgcaagtagtcaaatcctttccctttacagaggtggaaacggaggcccagatggggaaagggccttgtcctccatctcttacccaggcaggggcagggcctgagctcttaccctggcacctgggtagggagccagggccaaagaattaagagtgtgggtagcagagtcagacctcggtttcaaatctcggccctgctccacaagctgtccagccctggggaagtcacttaacctctctgtgcttcagtgtccttgtctgtgagctggggatagtgagtcactgacgatgaccacaagagcctggcacagagtaggcattgtacaagttagcagaatgatttccagcagcctgcgaggtcttggaccagctgccttgactctgacttccattttcctgcccctctgctagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggaga

SEQ ID NO: 122241 - DNA, 404 bp, Homo sapiens
  Payload ID: 3954
  Gene Symbol: CPNE2
  Gene Name: copine II
  ENST ID: ENST00000566259
  CDS Start-End: 160-404
cagggtccagtacgcctggctgctgctgggctggcgcagagggacccactcttccccccgcctgccccaactccagacatcatgtgctccccgtttcggggatccagaagcttccagccagaggactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttga

SEQ ID NO: 122242 - DNA, 1976 bp, Homo sapiens
  Payload ID: 3954
  Gene Symbol: CPNE2
  Gene Name: copine II
  Uniprot ID: Q96FN4
  ENST ID: ENST00000565874
  CDS Start-End: 193-1839
tttcttcaaacctttgcctatgttatttgacaacccgcctcaatttgccttccatctctccactcacctcttaaaggccaggtggtaatgcctccctatggtggggcagcatagcaggtgtctgtccactctctgaccctcacttctgttcccctagactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccc

SEQ ID NO: 122243 - DNA, 844 bp, Homo sapiens
  Payload ID: 3954
  Gene Symbol: CPNE2
  Gene Name: copine II
  ENST ID: ENST00000565766
  CDS Start-End: 1-844
tctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccccctgggccaggcttctccagagtacgtgctgcggtgagctcccagctgatcggggagacgggcactgctctaccaggcaaccccaggttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtt

SEQ ID NO: 122244 - DNA, 4760 bp, Homo sapiens
  Payload ID: 3955
  Gene Symbol: CPNE3
  Gene Name: copine III
  Uniprot ID: O75131
  ENST ID: ENST00000198765
  CDS Start-End: 59-1672
tatgacttttaaaattcatgaatttgaataattcatcagttttctcagaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctccacagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacagagtagtgtgttttcatttttattctttacatgtgaccaaaacaatagaaaagttaaaaataaaatatagtgttttaggtggc

SEQ ID NO: 122245 - DNA, 446 bp, Homo sapiens
  Payload ID: 3955
  Gene Symbol: CPNE3
  Gene Name: copine III
  ENST ID: ENST00000522240
  CDS Start-End: 210-446
gttcctgggccggtgaggcagcagcccagcaaccgtaccgcccgggggaaaaggaaagtcctggcctggaggatccgagcccgcaggctccgtgcggcaggtcccgccgggccctgctgctggaagtgctccgtgggcttcgcgcagctggggatcggcaggaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtt

SEQ ID NO: 122246 - DNA, 785 bp, Homo sapiens
  Payload ID: 3955
  Gene Symbol: CPNE3
  Gene Name: copine III
  ENST ID: ENST00000517391
  CDS Start-End: 1-785
acaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaat

SEQ ID NO: 122247 - DNA, 656 bp, Homo sapiens
  Payload ID: 3955
  Gene Symbol: CPNE3
  Gene Name: copine III
  ENST ID: ENST00000523469
  CDS Start-End: 198-656
ctccaccgtcgctcgacttccacctctaagactcccacgaaactcaggttgaataattcatcaaattacacaactgctaattaactattaattagaggctttagtgctctgaagggattttggcataaaggggaaaatacctgggtttatgctgtggtggtgacacttactagctttgtgatcccataactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataag

SEQ ID NO: 122248 - DNA, 4865 bp, Homo sapiens
  Payload ID: 3955
  Gene Symbol: CPNE3
  Gene Name: copine III
  Uniprot ID: O75131
  ENST ID: ENST00000517490
  CDS Start-End: 164-1777
cttgctctgccagtccagccctaggttctcctgaatccctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctccacagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacagagtagtgtgttttcatttttattctttacatgtgaccaaaacaatagaaaagttaaaaataaaatatagtgttttaggtggc

SEQ ID NO: 122249 - DNA, 680 bp, Homo sapiens
  Payload ID: 3955
  Gene Symbol: CPNE3
  Gene Name: copine III
  ENST ID: ENST00000620393
  CDS Start-End: 274-680
agtccagccctaggttctcctgaatccctgcggtcccagcgtcgctccggacgctgccaacctgttctccaccgtcgctcgacttccacctctaagactcccacgaaactcaggttgaataattcatcaaattacacaactgacggagtcttgctctgtcgcccaggttggaatgcaatggcgtgatctcactgaccgaaacctccgcctctgaggttcaagtgattctcctgcctcagcctcctgagtagctgggattacagaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaa

SEQ ID NO: 122250 - DNA, 279 bp, Homo sapiens
  Payload ID: 3955
  Gene Symbol: CPNE3
  Gene Name: copine III
  ENST ID: ENST00000621526
  CDS Start-End: 254-279
agccctaggttctcctgaatccctgcggtcccagcgtcgctccggacgctgccaacctgttctccaccgtcgctcgacttccacctctaagactcccacgaaactcaggttgaataattcatcaaattacacaactgggtcttgctctgtcacccaggctgcagtgcatagcttactgtggcctcgaactcctgaacttgagtgagcctcctgccttagcctactgagtagctgggactacagaactcaagacatggctgcccagtgtgtcacaaaggt

SEQ ID NO: 122251 - DNA, 581 bp, Homo sapiens
  Payload ID: 3955
  Gene Symbol: CPNE3
  Gene Name: copine III
  ENST ID: ENST00000621245
  CDS Start-End: 164-581
gaatccctgcggtcccagcgtcgctccggacgctgccaacctgttctccaccgtcgctcgacttccacctctaagactcccacgtgagtgcgggcgtctcccagttcctgggccggaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagag

SEQ ID NO: 122252 - DNA, 817 bp, Homo sapiens
  Payload ID: 3955
  Gene Symbol: CPNE3
  Gene Name: copine III
  ENST ID: ENST00000621783
  CDS Start-End: 116-817
cagtccagccctaggttctcctgaatccctgcggtcccagcgtcgctccggacgctgccaacctgttctccaccgtcgctcgacttccacctctaagactcccacaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgaca

SEQ ID NO: 122253 - DNA, 4184 bp, Homo sapiens
  Payload ID: 3956
  Gene Symbol: CPNE4
  Gene Name: copine IV
  Uniprot ID: Q96A23
  ENST ID: ENST00000429747
  CDS Start-End: 878-2551
gctcctgccatacgccagacagttttgtagacacgaaggatccagagattagcaacacctttaccatttttggtgacagttaagcacccatctaagaagttttctttggtgagtgccaaaaagtgtaactcccattccccccacacccgcgccgcgatacgaccgctccaccctagagtggagatggagaccaagcacttggagatctaaatcaagtgtccccaggagctcagttgagcgacaaagctgagcagaaagcccagactgcgggcgcggcaggaccacggagagcgccgccgccaaggcctgggcggggcctgagctcgggttcccggggcaatgctcgtctccgtcagcaacccccagggggcgctcgcgcggaggtttcggaaccagtctcttgccgggttgctgggtgcatgggattcgtcagaaggtggaaatctctctgtgagaagctgccatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattcttct

SEQ ID NO: 122254 - DNA, 577 bp, Homo sapiens
  Payload ID: 3956
  Gene Symbol: CPNE4
  Gene Name: copine IV
  ENST ID: ENST00000505957
  CDS Start-End: 358-577
atcaaacagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccag

SEQ ID NO: 122255 - DNA, 2120 bp, Homo sapiens
  Payload ID: 3956
  Gene Symbol: CPNE4
  Gene Name: copine IV
  Uniprot ID: Q96A23
  ENST ID: ENST00000502818
  CDS Start-End: 221-1948
aatgctcaccctgactcattcagggaaggatccaaggtttttgatgcagggcactgactctctgcctgtttttccccttcatcatctgctccccttaaaaaatggtatcaactgcattgaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctga

SEQ ID NO: 122256 - DNA, 5431 bp, Homo sapiens
  Payload ID: 3956
  Gene Symbol: CPNE4
  Gene Name: copine IV
  Uniprot ID: Q96A23
  ENST ID: ENST00000512055
  CDS Start-End: 2128-3801
acaccagcggctggacattgagaggatcacagcagtggaaaaagacacaagcacctagccgttgagaggaacgcactggcctaagaacatactgacagacgccggtaggccagcagggcggcaggccatcaacccgcggaaggacacggactttggccagggcggtataaggagcctaaaggacgtcatacccatgggccagacctaacattcctttctgctgatcccaagtttttagacaaagtttcccttccttaaccaattgcgaatcagaaaatcctcgaatccaccaatgacctataccagtaaagatgtcatctggccaatttgtgtgaaaaaagagaataattctcatccaaaccgcctgtctctggaaataagaaaagctctgagggtctccaaagttaccagaggaaggctgaattttatggtgattgataatatttccaagcttatggagaaaaaaatatcattagtcttttccatggtagaaaagagtaaagcctgtaacaaaaaaagtgatacagtggatgggatgatgagacccttgaaataagcaaggatggaccagaaactggtaacactcacccatggaatttcattatgaagtcgtggcaagggccaagccgacctggatttgaaacccatctcttcaacgatgtagattttgacaacatatttgatttctctgggcctcagtttgttatctgcacaaaagggagatatgagtggttacgttattggattgtcatgaacattaaataggataatgtcaaatcattcagccaagtttctagcatatagtacaggttcaaatattatcttttttttcccaccaacctcttttccaggaaaatgcaaagctactctttagccaaattttaaaacaggggatatttattttgggaatcattaatacccatctgccccttttttggtccattggacatattgaaatgaatgattaatacttatcacttcatggtgtacacattgttttgtttcttatatccagagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttggtgagtgccaaaaagtgtaactcccattccccccacacccgcgccgcgatacgaccgctccaccctagagtggagatggagaccaagcacttggagatctaaatcaagtgtccccaggagctcagttgagcgacaaagctgagcagaaagcccagactgcgggcgcggcaggaccacggagagcgccgccgccaaggcctgggcggggcctgagctcgggttcccggggcaatgctcgtctccgtcagcaacccccagggggcgctcgcgcggaggtttcggaaccagtctcttgccgggttgctgggtgcatgggattcgtcagaaggtggaaatctctctgtgagaagctgccatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattct

SEQ ID NO: 122257 - DNA, 2503 bp, Homo sapiens
  Payload ID: 3956
  Gene Symbol: CPNE4
  Gene Name: copine IV
  Uniprot ID: Q96A23
  ENST ID: ENST00000511604
  CDS Start-End: 578-2251
gagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattaca

SEQ ID NO: 122258 - DNA, 2230 bp, Homo sapiens
  Payload ID: 3956
  Gene Symbol: CPNE4
  Gene Name: copine IV
  Uniprot ID: Q96A23
  ENST ID: ENST00000512332
  CDS Start-End: 184-1911
gagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgcta

SEQ ID NO: 122259 - DNA, 561 bp, Homo sapiens
  Payload ID: 3956
  Gene Symbol: CPNE4
  Gene Name: copine IV
  ENST ID: ENST00000505881
  CDS Start-End: 55-561
agaagggtacaaatcttttttctttctccaaggagaatcttttgagcacaatgaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaag

SEQ ID NO: 122260 - DNA, 550 bp, Homo sapiens
  Payload ID: 3956
  Gene Symbol: CPNE4
  Gene Name: copine IV
  ENST ID: ENST00000514999
  CDS Start-End: 303-550
gttggagagccagtgacatcccaggcttttgcccaaatgtccttgagttctacaccctgagccttgaaatgcagcttttctggggctgacttcccaggatcggtggtgctgtactttcaggagatggtgtttgctggccagtgaagcacaaaatcagagtgaatgtggttcacatacagctttatgtaggtgcatcaacgagcctggaactaggtgccgggtgccctctaagacaccaagagctattttggaaatagaaagggaacaagtatataaaaatggaagatccagaaatacaaggaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggactt

SEQ ID NO: 122261 - DNA, 3556 bp, Homo sapiens
  Payload ID: 3956
  Gene Symbol: CPNE4
  Gene Name: copine IV
  Uniprot ID: Q96A23
  ENST ID: ENST00000617767
  CDS Start-End: 196-1923
attccaggatttcacttgtcacactgatgggtgagatgcctttcatattggcataagacactgagcggatgcctcctcttatcttatcaaacagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattcttct

SEQ ID NO: 122262 - DNA, 3897 bp, Homo sapiens
  Payload ID: 3957
  Gene Symbol: CPNE5
  Gene Name: copine V
  Uniprot ID: Q9HCH3
  ENST ID: ENST00000244751
  CDS Start-End: 626-2407
gggcagatttgattttcccgcagcccgggcgccccggagccgaagcccgagccgaggaggtggcgctcgcagccgcgtctcagccccgtcgccgccggcgccaagacccagggagaggcggcgcagcccgggcgctcgggctccgcgctgccggcgccccgccacccccgccgccagcgccccatccggcgcctcccgctcctcacgcccctctccctgtcttctgcatcccctctacctctgcccacagacgcgcgtccctctcctggtgcccctctccacgactccgcgtttccctcccggtgccctctccccgagcccctctccccgcgcccctctctgccttccccgctgtgcccccgctccctgggctccttgcccttccccactgggcccctagcctcctcgcggcgtcacccgagccccctcctcgatccgcggcccccgctccctccgccctcttccctctctcacttcccacgccccctcttcgcgctcctctctcctccccttgccgcccagcccaggctctggagttgggggagagcccagggctccagtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtacgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagt

SEQ ID NO: 122263 - DNA, 2542 bp, Homo sapiens
  Payload ID: 3957
  Gene Symbol: CPNE5
  Gene Name: copine V
  Uniprot ID: Q9HCH3
  ENST ID: ENST00000393189
  CDS Start-End: 147-1052
gaagtagatagcaatactcacccagacagaagagaccacggtaaagatcagctgacggcctctgtgggaacaaagacagggaaaggggaaatgagttcaccagaaaccaacaggcagcacaggaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagt

SEQ ID NO: 122264 - DNA, 870 bp, Homo sapiens
  Payload ID: 3957
  Gene Symbol: CPNE5
  Gene Name: copine V
  ENST ID: ENST00000633136
  CDS Start-End: 1-870
gcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggaagtggtctttggatggaaagtttgagaaccactggtctggaagcctccggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtacgactgggatcgggacggcagccatgacttcattggggagttcaccaccagttaccgggagctggcccgtgggcagagccaattcaacatctatgaggtggtaaacccg

SEQ ID NO: 122265 - DNA, 745 bp, Homo sapiens
  Payload ID: 3957
  Gene Symbol: CPNE5
  Gene Name: copine V
  ENST ID: ENST00000633280
  CDS Start-End: 68-745
agtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtctttggatggaaagtttgagaaccactggtctggaagcctccggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatgga

SEQ ID NO: 122266 - DNA, 2235 bp, Homo sapiens
  Payload ID: 3958
  Gene Symbol: CPNE6
  Gene Name: copine VI (neuronal)
  Uniprot ID: O95741
  ENST ID: ENST00000397016
  CDS Start-End: 312-1985
agtccttcagcagatgccctcatgtgaccaggatatgaggttgggtgtccttaagcaattatgtccatttcctgtgtctccttataaaatggtggctagggaactggacatcattctcaaagctatgacgttcagcaaggtatgtgatggcttttaaggagcacgggaagatcacatcctgctgtattccgggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtggccattgacttcaccgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaa

SEQ ID NO: 122267 - DNA, 2233 bp, Homo sapiens
  Payload ID: 3958
  Gene Symbol: CPNE6
  Gene Name: copine VI (neuronal)
  Uniprot ID: O95741
  ENST ID: ENST00000537691
  CDS Start-End: 147-1985
agtccttcagcagatgccctcatgtgaccaggatatgaggttgggtgtccttaagcaattatgtccatttcctgtgtctccttataaaatggtggctagggaactggacatcattctcaaagctatgacgttcagcaaggtatgtgatggcttttaaggagcacgggaagatcacatcctgctgtattccgggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtggccattgacttcaccgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctct

SEQ ID NO: 122268 - DNA, 570 bp, Homo sapiens
  Payload ID: 3958
  Gene Symbol: CPNE6
  Gene Name: copine VI (neuronal)
  ENST ID: ENST00000559207
  CDS Start-End: 239-570
gcaagggagtcagggccagggccagagagccggagagaggagcccccgaccgagagcccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggccca

SEQ ID NO: 122269 - DNA, 573 bp, Homo sapiens
  Payload ID: 3958
  Gene Symbol: CPNE6
  Gene Name: copine VI (neuronal)
  ENST ID: ENST00000559197
  CDS Start-End: 115-573
ataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtgagagcagctcaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatca

SEQ ID NO: 122270 - DNA, 575 bp, Homo sapiens
  Payload ID: 3958
  Gene Symbol: CPNE6
  Gene Name: copine VI (neuronal)
  ENST ID: ENST00000560884
  CDS Start-End: 97-575
ggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacggtaggcaagatcacctgtactcacccttggtccagatcgtggccgaggaggtatca

SEQ ID NO: 122271 - DNA, 589 bp, Homo sapiens
  Payload ID: 3958
  Gene Symbol: CPNE6
  Gene Name: copine VI (neuronal)
  ENST ID: ENST00000560828
  CDS Start-End: 115-589
ataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacggatctgttcagcaagtctgaccctttcatggaaatctataagaccaacgagg

SEQ ID NO: 122272 - DNA, 590 bp, Homo sapiens
  Payload ID: 3958
  Gene Symbol: CPNE6
  Gene Name: copine VI (neuronal)
  ENST ID: ENST00000558859
  CDS Start-End: 513-590
tccaggccccataaatagcagcagagccggagctggagccggcgccagcggctggagcagcaagggagtcagggccagggccagagagccggagagaggagcccccgaccgagagcccaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacggtaggcaagatcacctgtactcacccttggtccagatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaac

SEQ ID NO: 122273 - DNA, 964 bp, Homo sapiens
  Payload ID: 3958
  Gene Symbol: CPNE6
  Gene Name: copine VI (neuronal)
  ENST ID: ENST00000558541
  CDS Start-End: 287-964
actgtgtctgtgggggtcctgcctctaagccacccccagcctgccctcctcccccggttctgtggctccctcccaggctgtggccctgccccttccctcttctccctcccaatccatccacgcggggggagctggtgctgcgcccccccccacccctccccatccaggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctg

SEQ ID NO: 122274 - DNA, 543 bp, Homo sapiens
  Payload ID: 3958
  Gene Symbol: CPNE6
  Gene Name: copine VI (neuronal)
  ENST ID: ENST00000559778
  CDS Start-End: 227-543
gctgtattccgggttagtttgagtgagtacatgtgtgacaaggacagcccagtgttcctgtatatgtgactgcagatatccttagctagtgtaacaatgttgaaagtgatgtgagaagggcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgatacctt

SEQ ID NO: 122275 - DNA, 657 bp, Homo sapiens
  Payload ID: 3958
  Gene Symbol: CPNE6
  Gene Name: copine VI (neuronal)
  ENST ID: ENST00000560761
  CDS Start-End: 211-657
agatatccttagctagtgtaacaatgttgaaagtgatgtgagaaggggccccataaatagcagcagagccggagctggagccggcgccagcggctggagcagcaagggagtcagggccagggccagagagccggagagaggagcccccgaccgagagcccaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggc

SEQ ID NO: 122276 - DNA, 591 bp, Homo sapiens
  Payload ID: 3958
  Gene Symbol: CPNE6
  Gene Name: copine VI (neuronal)
  ENST ID: ENST00000558450
  CDS Start-End: 199-591
atgtccatttcctgtgtctccttataaaatggtggctagggaactggacatcattctcaaagctatgacgttcagcaaggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaat

SEQ ID NO: 122277 - DNA, 453 bp, Homo sapiens
  Payload ID: 3958
  Gene Symbol: CPNE6
  Gene Name: copine VI (neuronal)
  ENST ID: ENST00000557889
  CDS Start-End: 296-453
cagtgagtttatgtactggcgcctgtgtgtgtcaagatatgtgtgagcctgtgagtcgtgggtgcatgtgtcgccatcatttctctgtttgaatgtgtatgtgcatgccactgcaatgtgcgcatctctgcgattctgggtgtgggtgtagtgtgaaggggaagatgtgtgtcactgtgtctgtgggggtcctgcctctaagccacccccagcctgccctcctcccccggttctgtggctccctcccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagca

SEQ ID NO: 122278 - DNA, 1226 bp, Homo sapiens
  Payload ID: 3958
  Gene Symbol: CPNE6
  Gene Name: copine VI (neuronal)
  ENST ID: ENST00000558795
  CDS Start-End: 85-282
ggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacggtaggcaagatcacctgtactcacccttggtccaggtattcaatgcccctgcatggacacctatggtgacatcatgcccaggaccacccccacctaagggaaaggggatggggtggcccttgtggtaaggttaggggagtcctgccacttgtatcccccttgcagatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagt

SEQ ID NO: 122279 - DNA, 733 bp, Homo sapiens
  Payload ID: 3958
  Gene Symbol: CPNE6
  Gene Name: copine VI (neuronal)
  ENST ID: ENST00000560356
  CDS Start-End: 311-733
agatgccctcatgtgaccaggatatgaggttgggtgtccttaagcaattatgtccatttcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacg

SEQ ID NO: 122280 - DNA, 2657 bp, Homo sapiens
  Payload ID: 3959
  Gene Symbol: CPNE7
  Gene Name: copine VII
  Uniprot ID: Q9UBL6
  ENST ID: ENST00000268720
  CDS Start-End: 131-2032
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagccagcccaaaagtggcttctgcaagtcgtgatgagagtgtctgttgatgtgctgggccctgctggacactgcgctaagcacttcctgtgctgcacggaatcctcacaccttgccaggacgggtccttcttttttattgaggtatgatgacctctgcctcccctgggcgactgctggcgccgtgaggtggtggacgtgcaggggtggccacacgcagggatggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctatccttgta

SEQ ID NO: 122281 - DNA, 2409 bp, Homo sapiens
  Payload ID: 3959
  Gene Symbol: CPNE7
  Gene Name: copine VII
  Uniprot ID: Q9UBL6
  ENST ID: ENST00000319518
  CDS Start-End: 108-1784
gcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctatccttgta

SEQ ID NO: 122282 - DNA, 576 bp, Homo sapiens
  Payload ID: 3959
  Gene Symbol: CPNE7
  Gene Name: copine VII
  ENST ID: ENST00000525982
  CDS Start-End: 117-479
ttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcaggtatgatgacctctgcctcccctgggcgactgctggcgccgtgaggtggtggacgtgcaggggtggccacacgcagggatggcagattgtggcccagaagaag

SEQ ID NO: 122283 - DNA, 488 bp, Homo sapiens
  Payload ID: 3959
  Gene Symbol: CPNE7
  Gene Name: copine VII
  ENST ID: ENST00000526232
  CDS Start-End: 1-277
gttcgtgcccttccgggagctcaagaaccagagaacagcacaaggggctcctgggatccaccacgcggcttcccccgttgctgccaacctctgcgacccggcgagacacgcacagcacacacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagcc

SEQ ID NO: 122284 - DNA, 519 bp, Homo sapiens
  Payload ID: 3959
  Gene Symbol: CPNE7
  Gene Name: copine VII
  ENST ID: ENST00000529800
  CDS Start-End: 1-519
ttccacagggtgtactccttcctggactatatcatgggcggctgccagatccacttcaccacaaaacgtgaacgaggagaaactggagtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacaca

SEQ ID NO: 122285 - DNA, 682 bp, Homo sapiens
  Payload ID: 3959
  Gene Symbol: CPNE7
  Gene Name: copine VII
  ENST ID: ENST00000568977
  CDS Start-End: 1-297
gacagtgacaagaggttttccgctttggggtttggagcccggatccctcccaagtatgaggtgtcccatgactttgccatcaatttcaaccctgaggacgatgagtgtgaagcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaa

SEQ ID NO: 122286 - DNA, 3489 bp, Homo sapiens
  Payload ID: 3960
  Gene Symbol: CPNE8
  Gene Name: copine VIII
  Uniprot ID: Q86YQ8
  ENST ID: ENST00000331366
  CDS Start-End: 98-1792
accctcaacccccatccccgcctgacgggagctagccctcagtccgcccgagctgtggttgtgggcgccggacaagtccaaggcgcctcctcccaatatggacagccgctacaacagcactgcgggcatcggggacttgaaccagctgagcgctgccatcccggccacgcgggtggaggtgtccgtgtcctgcagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgaggtggtgaatcccaaaaagaaaggaaaaaagaaaaaatatactaattctggaacagtaactttactctctttcttggtagaaacagaagtttcattccttgactacattaagggagggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagttaatgctttgtgcctggtgctctgtaatgaaccaggcaatgagatagttttctcagtttggtttcagcagttaatgtgctttcttggatccaaatttaaatatcttcctaaaccaaaactgtaaatatggttgttgcatgagcaacagaaaaaattgtttaaatgcttgaagcaaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcaatgttatataactatgtaataattgttgatttttaattatgtattaaaatctttaaatcataactatttgctttgtacgtttcatgtatgaatgacaatagtttgatgatttcctttactgatcttaaatatttatgccactacagtgtattacctacagatttttaaatttagctttatttatcaacccaaaaaacaaataaataagatcaatattcttttcttcttgtcaaaca

SEQ ID NO: 122287 - DNA, 1757 bp, Homo sapiens
  Payload ID: 3960
  Gene Symbol: CPNE8
  Gene Name: copine VIII
  ENST ID: ENST00000360449
  CDS Start-End: 51-1709
ggtgatggcttcacagggagatacatgagtcaacatttatcgaatgatggatgcactttaagtgcagttcattatatatgttatacctcactgaagtggaaacaaattggataaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgaggtggtgaatcccaaaaagaaaggaaaaaagaaaaaatatactaattctggaacagtaactttactctctttcttggtagaaacagaagtttcattccttgactacattaagggagggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagtt

SEQ ID NO: 122288 - DNA, 2875 bp, Homo sapiens
  Payload ID: 3960
  Gene Symbol: CPNE8
  Gene Name: copine VIII
  Uniprot ID: Q86YQ8
  ENST ID: ENST00000538596
  CDS Start-End: 650-1351
aaagtgctcagcagaaaggaggccctagagtgggtagctcctttctgctgctggtcaaccccatccttaccaggcatccatcccatcggcccaggaatctgtctgcctcctgctgctcttcttggcacctgggctcagcactgactttgctccaagattagagcggaagccaacagcagggagaagccaggcagtgggagtaggcacttctgagcctgtgagggcaggagctcttcctgggcccccaagggtacagggatgcctgagcttgcagctgtggtttgggcaactgcagctgtgtggggaaatgcgagggggcagctcctgcctgctccatggagcaggagtggcctgggaggtctgagtctgtagccgtggcttggatgactgcagtgcacctggggagctcctaccccaactcggaaaaggcagagctcccacttgtccctggctcccacacgctccccggagcatgcagccccggctgtgcctccttgctgcagccagcgtgatggcagcgtaaggctgtctggagcagctgctgccatcaatagttgataaagaaataaggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagttaatgctttgtgcctggtgctctgtaatgaaccaggcaatgagatagttttctcagtttggtttcagcagttaatgtgctttcttggatccaaatttaaatatcttcctaaaccaaaactgtaaatatggttgttgcatgagcaacagaaaaaattgtttaaatgcttgaagcaaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcaatgttatataactatgtaataattgttgatttttaattatgtattaaaatctttaaatcataa

SEQ ID NO: 122289 - DNA, 549 bp, Homo sapiens
  Payload ID: 3960
  Gene Symbol: CPNE8
  Gene Name: copine VIII
  ENST ID: ENST00000550863
  CDS Start-End: 514-549
cacaatgccccaccgtccccaactctcaagtggccgacagtgggcagtccagaagctgggaccagactcatctgcccgagggcacagtaggagggacggagggatctcccaagagctccgagggcgagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggac

SEQ ID NO: 122290 - DNA, 942 bp, Homo sapiens
  Payload ID: 3961
  Gene Symbol: CCS
  Gene Name: copper chaperone for superoxide dismutase
  ENST ID: ENST00000310190
  CDS Start-End: 111-878
ggggtggtgactgggtccagaatggcttcggattcggggaaccaggggaccctctgcacgcgatcatcggttggtccctgccgcccttgcagttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagaggggg

SEQ ID NO: 122291 - DNA, 1214 bp, Homo sapiens
  Payload ID: 3961
  Gene Symbol: CCS
  Gene Name: copper chaperone for superoxide dismutase
  ENST ID: ENST00000530961
  CDS Start-End: 62-811
cgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatga

SEQ ID NO: 122292 - DNA, 1430 bp, Homo sapiens
  Payload ID: 3961
  Gene Symbol: CCS
  Gene Name: copper chaperone for superoxide dismutase
  Uniprot ID: O14618
  ENST ID: ENST00000533244
  CDS Start-End: 442-1266
cagcttggccacctggctgcacagcgacgccaccgtcagcttcgccagagggaaggactgcagaatccggccctcctgcggggggcgcttctgaggctctggggacgtcgtcctagtggggaagagcgacagcggacgcagcagccggtggtaaaaccgctggagctcaggctcgggcttcgggggctccatcatagagccggcggccgccaccgtccaggaacagaaagccgaggggttactaaggcaaccaggagcccgacggcccgagtgcgcctgcgcggccgccacccggtggctgacgaagcagggccttgcgtgcgcacgcactaggaggaggagttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 122293 - DNA, 777 bp, Homo sapiens
  Payload ID: 3961
  Gene Symbol: CCS
  Gene Name: copper chaperone for superoxide dismutase
  ENST ID: ENST00000534763
  CDS Start-End: 574-777
ggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcacc

SEQ ID NO: 122294 - DNA, 911 bp, Homo sapiens
  Payload ID: 3962
  Gene Symbol: COMMD1
  Gene Name: copper metabolism (Murr1) domain containing 1
  Uniprot ID: Q8N668
  ENST ID: ENST00000311832
  CDS Start-End: 33-605
tcagctgttgcggggcggggccttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcttcctgcctctacttgctcagatttctttttttctagctttcatttagtcttacatttgttccagtgcagaggttctcacccttcagtgtgcataaatgttataaggggtacttgtaaaagcattcacttttttgttgttattattaaattcggagtgttgctctgttgcccaggctggagtgcagtgg

SEQ ID NO: 122295 - DNA, 388 bp, Homo sapiens
  Payload ID: 3962
  Gene Symbol: COMMD1
  Gene Name: copper metabolism (Murr1) domain containing 1
  ENST ID: ENST00000455659
  CDS Start-End: 1-152
accccggcatcacagaggagctgctacggagccagctatatccagaggtgccacccgaggagttccgcccctttctggcaaagatgagggggattcttaagagacagaatctccccatatcgtccagggtggtctcaaattcctgggcttaagcaaccctctctctttagcctcccaattgctgggattacagcagctattctgggcctggaaacttgacttgggttaaaggagtggctggtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctc

SEQ ID NO: 122296 - DNA, 770 bp, Homo sapiens
  Payload ID: 3962
  Gene Symbol: COMMD1
  Gene Name: copper metabolism (Murr1) domain containing 1
  ENST ID: ENST00000458337
  CDS Start-End: 1-115
acaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaagtcctttccacgctacctgcagaggggtccatacggcgttgttctggattcccatcgtaacttaaagggaaactttcacaatgtccggagcccttgatgtcctgcaaatgaaggaggaggatgtccttaagttccttgcagcaggaactcacttaggtggcaccaatcttgacttccagatggaacagtacatctataaaaggaaaagtgatggcatctatatcataaatctgaagaggacctgggagaagcttctgctggcagctcgtgctattgttgccattgaaaaccctgctgatgtcagtgttatatcctccaggaatactggccagagggccgtgctaaagtttgctgctgccactggagccactccaattgctggccgcttcactcctggaaccttcgctaaccagatccaggcagccttccgggagccacggcttcttgtggttactgaccccagggctgaccaccagcctctcatggaggcatcttatgttaacctacctaccattgcgctgtgtaacacagattctcctctgcactatgtggacattgccatcccatgcaacaacaagggagctcactcagtgggtttgatgtggtggatgctggctc

SEQ ID NO: 122297 - DNA, 743 bp, Homo sapiens
  Payload ID: 3962
  Gene Symbol: COMMD1
  Gene Name: copper metabolism (Murr1) domain containing 1
  ENST ID: ENST00000444166
  CDS Start-End: 1-97
gtgtttggaatttgatgaggtcaaagtcaaccaaattctgaagacgctgtcagaggtagaagaaagtatcagcacactgatcagccagcctaactgaagatgatgtatgaaggagttggagttgttgaaaccaagaggggtccatacggcgttgttctggattcccatcgtaacttaaagggaaactttcacaatgtccggagcccttgatgtcctgcaaatgaaggaggaggatgtccttaagttccttgcagcaggaactcacttaggtggcaccaatcttgacttccagatggaacagtacatctataaaaggaaaagtgatggcatctatatcataaatctgaagaggacctgggagaagcttctgctggcagctcgtgctattgttgccattgaaaaccctgctgatgtcagtgttatatcctccaggaatactggccagagggccgtgctaaagtttgctgctgccactggagccactccaattgctggccgcttcactcctggaaccttcgctaaccagatccaggcagccttccgggagccacggcttcttgtggttactgaccccagggctgaccaccagcctctcatggaggcatcttatgttaacctacctaccattgcgctgtgtaacacagattctcctctgcactatgtggacattgccatcccatgcaacaacaagggagctcactcagtgggtttgatgtggtggatgctggctcgggaagttctgc

SEQ ID NO: 122298 - DNA, 785 bp, Homo sapiens
  Payload ID: 3962
  Gene Symbol: COMMD1
  Gene Name: copper metabolism (Murr1) domain containing 1
  ENST ID: ENST00000427417
  CDS Start-End: 1-115
acaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggaatactggccagagggccgtgctaaagtttgctgctgccactggagccactccaattgctggccgcttcactcctggaaccttcgctaaccagatccaggcagccttccgggagccacggcttcttgtggttactgaccccagggctgaccaccagcctctcatggaggcatcttatgttaacctacctaccattgcgctgtgtaacacagattctcctctgcactatgtggacattgccatcccatgcaacaacaagggagctcactcagtgggtttgatgtggtggatgctggctcgggaagttctgcgcatgcgtggcaccatttcctgtgaacacccatgggaggtcatgcctgatctgtacttctacagagatcctgaagagattgaaagagaagagcaggctgctgctgaaaaggcagtgaccaaggaggaatttcagggtgaatggactgctccagctcctgagttcactgttactcagcctgaggttgcagactggtctgaaggtgtacaggtgccctctgtgcctattccctactgaagacgggagcgctcagcctgccacggaagactggtctgcagctcccactgctcaggccactgaatgggtaggagcaaccactgac

SEQ ID NO: 122299 - DNA, 549 bp, Homo sapiens
  Payload ID: 3962
  Gene Symbol: COMMD1
  Gene Name: copper metabolism (Murr1) domain containing 1
  ENST ID: ENST00000445644
  CDS Start-End: 33-329
tcagctgttgcggggcggggccttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagacaggatcttgctgtgttgcccaggatagagtgcaatgggtattcataggcacaatcatggcacaccgtggccttgaactcctgggctcaagtgattctcctgcctcagcctcctgagcagctgggactacaggtgcacaccaccacatctggcttttatattctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggc

SEQ ID NO: 122300 - DNA, 2825 bp, Homo sapiens
  Payload ID: 3963
  Gene Symbol: CPOX
  Gene Name: coproporphyrinogen oxidase
  Uniprot ID: P36551
  ENST ID: ENST00000264193
  CDS Start-End: 220-1584
cgcgcagggacgccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagaacggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaataatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataagactaagaaa

SEQ ID NO: 122301 - DNA, 826 bp, Homo sapiens
  Payload ID: 3963
  Gene Symbol: CPOX
  Gene Name: coproporphyrinogen oxidase
  ENST ID: ENST00000513674
  CDS Start-End: 145-672
cggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacagaggaagctgcaaaacaaatgagaagcagaggaaaagttctgaagactaaagatgatactttgaagtagaagaagctgatgccattcagcttggttcaaccttttatgtttaaagttggtaactggtattgacaactcatggacctgtgagcacatgaaacagttattctcaagtg

SEQ ID NO: 122302 - DNA, 593 bp, Homo sapiens
  Payload ID: 3963
  Gene Symbol: CPOX
  Gene Name: coproporphyrinogen oxidase
  ENST ID: ENST00000512905
  CDS Start-End: 1-212
actgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgacaattctcagctatccttttcctcaactcagtggaggatttcttttgagggttcaaacccccaacttggccttgtaatcaactgagcacaggctgacctgggtctccatcacttcaagagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagg

SEQ ID NO: 122303 - DNA, 5291 bp, Homo sapiens
  Payload ID: 3964
  Gene Symbol: COBL
  Gene Name: cordon-bleu WH2 repeat protein
  Uniprot ID: O75128
  ENST ID: ENST00000265136
  CDS Start-End: 167-3952
ccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 122304 - DNA, 2332 bp, Homo sapiens
  Payload ID: 3964
  Gene Symbol: COBL
  Gene Name: cordon-bleu WH2 repeat protein
  Uniprot ID: O75128
  ENST ID: ENST00000395540
  CDS Start-End: 186-1595
ccgcccgctagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttatggagcagctgaagctgtgataagacttctgagcttgcttctgaataccacagccccgggcacagcaaagccaagaaccctgtggatgagtgagggccgcagttctctacacaatcctgaaatcaagtgttcctgtttctcttcctcctccccatttccccagtcactgctcagccttctcttgggtctttcaagcatttgtgaatgcatgtgcacacttagacacacacacgcacacacacacaacccatcttgtgtcttacctacctctgaaatattggcatttgggagacaatccctaatcagctaacacttgtttttttctatcctctgtgtgcttgttagaatactgtgaaggtgttttctatggaccgacttctaaatgttcctcctgaaatcagtgttattcacacagttctaatgtaatgaattctgtctgtctgaaagcttgccatattgtccctggtttctcccagctaatagagaggaaaatgagcctgaatatgaacccgtcaccacagaccgcactgcatcctttccaggcagcagggccctggagactgtgctcaggcctggcagcctctgtgtttcacttaggcttgttttgctcaacccaggcaagacttttaaaattgtttgaataagctgcagcatcagtatgcttttttaaattgtgatttaaaaaaaaatataaaatgtcccattccttccattttcaaatgcatacttcagtagatttaagtatattcacaatgctgtgaaaccgatctccaggacctcatcgtcctgcaaatctgatactctactcactgaacagcaactcccctttgcctgcttgtctttttgcgcctggcttatttcacttagcacaatttcctcgaagtttatccatattgtagcatataacagaattcccttcccttttaaagctaaatatctttcaagtatatgtatagaccacattttctttatccatccattgtcagtggacatttaagttgttcccgcttcatggttattgtgaatgatgctgcacaggtatgcaaa

SEQ ID NO: 122305 - DNA, 5339 bp, Homo sapiens
  Payload ID: 3964
  Gene Symbol: COBL
  Gene Name: cordon-bleu WH2 repeat protein
  Uniprot ID: O75128
  ENST ID: ENST00000395542
  CDS Start-End: 186-4001
ccgcccgctagagacgattccagccccttccgtccgccgcgctccgccgctgtcctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctt

SEQ ID NO: 122306 - DNA, 589 bp, Homo sapiens
  Payload ID: 3964
  Gene Symbol: COBL
  Gene Name: cordon-bleu WH2 repeat protein
  ENST ID: ENST00000449281
  CDS Start-End: 101-589
agtggtggagcaggtggtgcggtgctggtgttgggtgctggtgttgggtggtggtgcgtgctgtgtactttgggcacccgggtcgttgcccaggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaat

SEQ ID NO: 122307 - DNA, 3785 bp, Homo sapiens
  Payload ID: 3964
  Gene Symbol: COBL
  Gene Name: cordon-bleu WH2 repeat protein
  Uniprot ID: O75128
  ENST ID: ENST00000441453
  CDS Start-End: 132-1271
ctccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattctatattatgattctcttcattattctgttctcttcattattctattcatttcttcacccatttattcactaaacagtgacatagtacttacttgatgctaggtattacaccagttttgtgggctataagagtgaataacaagcacgtgacctctggccttggattttactacctgtggctccccaggcacatgaaaagaagtaaagatggttccatttgataagtactagtcacaagggttgtacatgtgataaagatgccagaggttgtgaccaccatgtctgtgcagaggtgctgctggctcctctttgagtgtgagatccctctgcagtcacacaacctcacccagttacgaagagctagtcacctcaactgcattgtcccaagacaggcagagtaggtaaaaatagtcatatgttaaaattcaaggtttagataaaaagacaactagttcttgcttgctttgattaacttttattatgcagatgcatttgaactggagaagcttgtcatgtttctctctaaaagatgtttttaaatgttattgctcaaaatggaaaaaaaaaaaaagaatcagtaagtattcctgacatgtaggattgttgcctggctgatcacaatgaaaatgttagctatgactaatgaaggaattatcacaacttacattggtattaataataaacaaatataagccaaagctatatataaccaatttagtgctatgtattggtgaaaaaaacagaaagttacagaaattactcacaatgaaacatagaacaagttagaaagggccttttttttttttgaaataaaggacttttgtctgataagtagcagtcatttgacctcaaatcattaaatggggaaagtctaaacaagaaaaggtaatgtttacctgaatgttggggaaagcattaggatttatggcccagacttaaagattgtagaagattgtatataattacagcaataagcatttgtgtaagaagtagctattatgctgaagaaagatgggcacacaaaatctctaggcaaatccttggaacaggggaaagtgatactgctcatagaattattggttcgagaggcagcaaatatgatgcaataagtatatcaaactcaattaaaaatagaggacagaggtatgtggtgggggaaaacaaatgcaatagggctaagtcagcttacagggggtgaatataatttgaacatggcacccccaatttacttgatcataaagttagccaaagacatgagtggtcgatctttgacaatactctagtgatctccatgagagatggcctgatagatgttggatagaatgaagggccatttgatgaacaagttttgtagatttacatgtgacttggcactgtgctgacattagagccttctaagaatcagataaattaattaggtgaaacattttttcccaaagcacttgcatttcagaaagtttctcatttctgactcagcttagaacccatcccttgttacaggtcatttctcctccttataagccatgtctgtttcttttttccatcatgtcatacaccctatccacaaaagatggtagctcacgttttctaactagagacgtgcaggcaagttgagagcatgaagaatcccttgggaataccaattctgtagcaaatgctaaggtaaaagaaaaactatgcattatttttcaactatagttggcttaaattcttagtttcaccctggagaccatgttgccagtggacaattgagcatgctgtgatttataaaatgcaagctagtttatatgataatgtttgccatctcactttaccagtactgttgaccttttcatatgattctaaaatcacttacttgtaaataaatactcctagttctgtagatgaaa

SEQ ID NO: 122308 - DNA, 4660 bp, Homo sapiens
  Payload ID: 3964
  Gene Symbol: COBL
  Gene Name: cordon-bleu WH2 repeat protein
  ENST ID: ENST00000445054
  CDS Start-End: 1-3321
ctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 122309 - DNA, 1842 bp, Homo sapiens
  Payload ID: 3964
  Gene Symbol: COBL
  Gene Name: cordon-bleu WH2 repeat protein
  ENST ID: ENST00000452534
  CDS Start-End: 1-1842
ccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttca

SEQ ID NO: 122310 - DNA, 4780 bp, Homo sapiens
  Payload ID: 3964
  Gene Symbol: COBL
  Gene Name: cordon-bleu WH2 repeat protein
  ENST ID: ENST00000431948
  CDS Start-End: 1-3441
ctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatgggtggtggacggcaggtgccacaaaagcctcccagaggcactgctcggggtccaccccagttagtgcttcccccacccccgccctaccctcctcccgacacagacgtggtggagcctctcagctttcccggggaaggcgctggttccgaggcctcagacccgatacccaaactaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatctta

SEQ ID NO: 122311 - DNA, 1941 bp, Homo sapiens
  Payload ID: 3964
  Gene Symbol: COBL
  Gene Name: cordon-bleu WH2 repeat protein
  ENST ID: ENST00000632460
  CDS Start-End: 131-1315
tccgccggcccgcgtgggaggacgatgggtcagcgcggaaaaagtgaatgagggcggcagcggtggcggcggtagccagcgcctgactcggcgggcccggagcaccgcccgcgtcccggcccccggcaccatggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagttcgtctgagcaaaactcagtccgagccttccctgagctgtcaagaaacctttaggaaatcatcacttggcaatgatgagacagataaagagaagaaaaaatttctgggatttttcaaagttaataaaagaagcaatagtaagggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggtatctcttgggtcacagattgatttacagaagaagaagcggcgagcgccagctccccctccaccacagccaccaccaccgagtcccctgatccccaaccgcactgaggataaggaggagaacaggaagagcacgatggtttattgctgtgcgtcattccctactcaggccaagcgcttctgatggacgggcctcttcctgacctcggacctttcccagtgtctcttctgccctggctctgattttcctgttgttcttcctcctttcaggataaaagggctcattgtatacccagaatttacttcctttggggtttacatataaatgcattaataacagagatttgtttgattgaggtttatatttttttgaaggaggtaaattatatgcaaattttaggttgataatattcacctgtctgaaattcactgatacttggaaatgttcctgtgaagaactctgctttattttaattcattattaattcatgtttttcttattggatattcagttccagaatttattgccaatttttcttaaaactagattgtatccataaattgaccagtatagtcaatttggatagaactgaaactttctgtctacctggtaaaactaagtgcctaaaaacatgaactataaatgtagttactaggaactcacaacttatatatactatccattcaatgatacataggacccaatgtctttgtgtttttgaggttttcctgttactgtgtactttgccattttacatagttcactaaaaagaaagaagtgggagaagaagggtgttctattcattattc

SEQ ID NO: 122312 - DNA, 4898 bp, Homo sapiens
  Payload ID: 3965
  Gene Symbol: COBLL1
  Gene Name: cordon-bleu WH2 repeat protein-like 1
  Uniprot ID: Q53SF7
  ENST ID: ENST00000342193
  CDS Start-End: 217-3717
cggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtata

SEQ ID NO: 122313 - DNA, 9367 bp, Homo sapiens
  Payload ID: 3965
  Gene Symbol: COBLL1
  Gene Name: cordon-bleu WH2 repeat protein-like 1
  Uniprot ID: Q53SF7
  ENST ID: ENST00000375458
  CDS Start-End: 223-3609
cggcggcggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatacttgtagtttataattataataaaataatgttttaaaggtcacataggatttagggggctatgtatataaaccattaatacatgtatgttctgaaaagttgccttatcgacaccattttaggagaacatgtgctatcctgtcaatggggaaagaaatttgtgacaagtagttttcactcatcatatcctaaaataacagcacaaggaagatacaggaatggtctagaaccaacttttgactttcatgtataatttttagcatctaggcattttgcttttccttctttcctccaatcaagttatttatttatataatattaaaattataattcagattacatatatatgatagagtataaaatacattctttttcatccccagcatcccactctcctctccaaagatagctgttaatattttgatatgaagccctatatagatgtatttatatgaagtacatgtgtgcaggtttgttgggggcttttgtgtgtgtgtgtgtgtgtgtgtgtgtgtgtgtgtatgtgtgtttcttaacatgaaaggaggtcacactctaatactatgtaacaacttgccttttataccagcagtgttctggaagagcttttctttttacacatacagatcgatcgtatttctgttagccattctattgtttcttgctgcggtacataatgttggctggagtgaagagattggggttcagatcacaagtctgccacttatgagtcatgggatcttgggcaaattactttctctatgcttcattttctcttctgaaaaatgaattaatatgaataaaaatgaaccttattttaaaaacggcaggcaattcatcttttaaagttacctgatgtcaatactataagtgaacaggtattatttgcctaatatactccctattctttgaggagtgacccttcttccgatttcacctcttcatgaactgccagatctggccttggccactaggcactggcaacagcatacacactctgtcatcttatccaagtccttgaaatgagaccaatctttgtcctgagacttagttacttataggtgcttaaaacccaaagcgtcccaattgatacaattatgtatgtgtctaattccagtttactttgtacccactaccagtagagaaaataagtatcaaagaactaagaatcaaactcatcatttttaaaatctactgattttgataactgacttgaaagaaaagaacttgcaattagaggtcatagtgaagatttccagggtcaaagtgatttctgaggttttagatgtaaaaatatctcctatttatttgctatttcagagttgacaacaagatttttatttgatccacatatttaaaaggtgtgcaaagattgctactttacaaaggtcacagaagcagaggagtctcagagtcccacatccaattactaatttgttcttccccatgactaaatgtagcaaatgatgaagaaactggtgctagatttcaagggataccagaataggaagttatttgttctgaatcttcagttggttttccttttctcttaaatgttaccactttcctgcaaatttccatccttaatatgttagactgttcatatagatacattgtgtttacaacaaggaaaaaatgccaccatgtgctcagaacttttttgacaggtattttgagaagagttgtggaacattctggtaatttgtagagatctgttggcatctctgcttcacaaactggaaaaaatcatttgtaagtcttgctaattacttttcttggagaagaaaaaaaatgctacagttgcaaacaaatgtatagttttcaaaaagaagcaacttttttgctccccagtttattcttagtttccagcccacgccttgcgatagcgataggcatagtgatggcctcaattctttctctcttgcatccataccttttgctgtgatagcagtgatggcctcagttctttccctctcttgcatccgtaccttttgctgtgtgactttgcagctcctctcattaaagaggcagagccccctctcccacccataggagcaggttttgagagtaacagaatgaagtgaaaatgacactgtgccagttctaagaccagccctcaaaggttcatgtgtttctgcttgctttcactgtatttgaaatgttgctgtgagaaagacatctctgaaacagctgaatggtcctaagaaaaggatgagagatgcagggagcagagctcccaactgaggccagcctagatcacctaagagccaggcccccagtttactctgatgtgtaagcaataaatgcttaccccagcaataccaccaaggtttgtggttggtttatatacagcattaatgtggcaataggtgcaatacaccctgttaaacaaaccatacacatatgactctaaccctaatcataaattgattcagtctgttcagttccacaacgctgtttcctccagaatctcacagatgacttactaaatccaacacaaatacacctcagactttctgtctagctcccaaccagttaaaagcaattctaaatattttttttcttagtcgtagtgcaaaagtatattctctccctttctctatagttttctctcattttgtcttcagacctagaagcatgagagcccagctgtcaaagtcatctagacccccttcagaaggtcattaaatttgtctatttcacaggattgcaagataaaatacagaatgcccagttaaatttgaacttcggataaacaacaaatttttttttagtataagcatatcccatacaatatttgggatatacttatatttttatattgtttatctgacgttcaagctaactaggcatcctgtatttttcttagctaaatctggcaactgtgctatttcattgaaaacctgaaagtgtacaaagaaggaagaagcagaatctgccatatgagtaatagaagtgagcaggcccaggactccctaagtcaagaaaccaagaggcgtcattacggaaaagagtaactcaccctgtgtgctccttggtagttctccctcagcgatgcccccatgttatgaatggggaaaagttcactgaagggttcatagtgaagaaactttttggatgatttctgttggtgggttttggataccttcaagggatcagaaaataatatacttaggaaattttggtaatgtcatcattactctctacattattattatgacggttacaattgttaaatctaggtggtgggtatgtgggttatattgtacatgatttttaacttgtctgcatgtttgaaattataataaagtcaataaataaattattgagacactcctg

SEQ ID NO: 122314 - DNA, 9523 bp, Homo sapiens
  Payload ID: 3965
  Gene Symbol: COBLL1
  Gene Name: cordon-bleu WH2 repeat protein-like 1
  Uniprot ID: Q53SF7
  ENST ID: ENST00000392717
  CDS Start-End: 149-3763
ctttcggttcagcttccccagccggaccccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatttggggtgctttttaaaatatatagtttgtgtcaaccagcatatttatttcccttacctgatgcatacatttctattagccagtgaacaaacaagaaatttgtaagatttaccatttatcagggatccctagtgtacatttaagccctggcattctgactccaaaatgcatggtctaagcatttaaaatgtttagcatagttcctgatacatggcatggccatcttaaatgctaaatgttgctgctgttttccttgaatcagttggagagaccctcatatatagatacttaagttatgttgttataagcaagtagagaaaggagtgaattttttttaaaaaattgtgttgtcataattatctacttataaaaatataaatttggatccctaatttaaaccttcatatattttgagttggattgaagacttaaagacaagcgacatgtaagatgttttcaatatattaatatataagaaaggcttaatttatgaagatatgaaagttcctacaactcatgataagtctacctaatagaaatatcagcacattattcttacaagaggaaattcaaaaggccaacaaacatggaaaaaaaatactcttcactgataatcagggaaatacaagttaaaaacatggaaaggtaccacatcaaattagcaaaaacggaagtttcaaaatagcaagtgttgtcaggaacatcaaacagtgggaactctactgttggtgggaaaatacactggcataactaccagttctgcaatatctagtaaaattaaagattccttaccatgttaccttaaataagtacttatgcacatgcataaggagacatctgcaaaaatgttcacggcagccttgtgtaaaacagcagaaaggggtcctaacccgtgctcagctttagtaatgcatatattcatatgatagacttccacacagcagtccaaatgaacaagctagagctatatatgtcagcatgaatacatctcaaaaacaagtgacaagagtgagtggtggaacaagtcgtgttttatgaaattagttacataaagtataaatataaaaaatgatactataaattatggctgtatatgtaggaaaaaaatttgctggtggttacctgtgggaaccaagaaagactgaattgagatttataagaggcatcaattgtgttcgtagtattttataaactgctgtttgaaaacaagtgcttattatattctaaattctagtatacttgtagtttataattataataaaataatgttttaaaggtcacataggatttagggggctatgtatataaaccattaatacatgtatgttctgaaaagttgccttatcgacaccattttaggagaacatgtgctatcctgtcaatggggaaagaaatttgtgacaagtagttttcactcatcatatcctaaaataacagcacaaggaagatacaggaatggtctagaaccaacttttgactttcatgtataatttttagcatctaggcattttgcttttccttctttcctccaatcaagttatttatttatataatattaaaattataattcagattacatatatatgatagagtataaaatacattctttttcatccccagcatcccactctcctctccaaagatagctgttaatattttgatatgaagccctatatagatgtatttatatgaagtacatgtgtgcaggtttgttgggggcttttgtgtgtgtgtgtgtgtgtgtgtgtgtgtgtgtgtatgtgtgtttcttaacatgaaaggaggtcacactctaatactatgtaacaacttgccttttataccagcagtgttctggaagagcttttctttttacacatacagatcgatcgtatttctgttagccattctattgtttcttgctgcggtacataatgttggctggagtgaagagattggggttcagatcacaagtctgccacttatgagtcatgggatcttgggcaaattactttctctatgcttcattttctcttctgaaaaatgaattaatatgaataaaaatgaaccttattttaaaaacggcaggcaattcatcttttaaagttacctgatgtcaatactataagtgaacaggtattatttgcctaatatactccctattctttgaggagtgacccttcttccgatttcacctcttcatgaactgccagatctggccttggccactaggcactggcaacagcatacacactctgtcatcttatccaagtccttgaaatgagaccaatctttgtcctgagacttagttacttataggtgcttaaaacccaaagcgtcccaattgatacaattatgtatgtgtctaattccagtttactttgtacccactaccagtagagaaaataagtatcaaagaactaagaatcaaactcatcatttttaaaatctactgattttgataactgacttgaaagaaaagaacttgcaattagaggtcatagtgaagatttccagggtcaaagtgatttctgaggttttagatgtaaaaatatctcctatttatttgctatttcagagttgacaacaagatttttatttgatccacatatttaaaaggtgtgcaaagattgctactttacaaaggtcacagaagcagaggagtctcagagtcccacatccaattactaatttgttcttccccatgactaaatgtagcaaatgatgaagaaactggtgctagatttcaagggataccagaataggaagttatttgttctgaatcttcagttggttttccttttctcttaaatgttaccactttcctgcaaatttccatccttaatatgttagactgttcatatagatacattgtgtttacaacaaggaaaaaatgccaccatgtgctcagaacttttttgacaggtattttgagaagagttgtggaacattctggtaatttgtagagatctgttggcatctctgcttcacaaactggaaaaaatcatttgtaagtcttgctaattacttttcttggagaagaaaaaaaatgctacagttgcaaacaaatgtatagttttcaaaaagaagcaacttttttgctccccagtttattcttagtttccagcccacgccttgcgatagcgataggcatagtgatggcctcaattctttctctcttgcatccataccttttgctgtgatagcagtgatggcctcagttctttccctctcttgcatccgtaccttttgctgtgtgactttgcagctcctctcattaaagaggcagagccccctctcccacccataggagcaggttttgagagtaacagaatgaagtgaaaatgacactgtgccagttctaagaccagccctcaaaggttcatgtgtttctgcttgctttcactgtatttgaaatgttgctgtgagaaagacatctctgaaacagctgaatggtcctaagaaaaggatgagagatgcagggagcagagctcccaactgaggccagcctagatcacctaagagccaggcccccagtttactctgatgtgtaagcaataaatgcttaccccagcaataccaccaaggtttgtggttggtttatatacagcattaatgtggcaataggtgcaatacaccctgttaaacaaaccatacacatatgactctaaccctaatcataaattgattcagtctgttcagttccacaacgctgtttcctccagaatctcacagatgacttactaaatccaacacaaatacacctcagactttctgtctagctcccaaccagttaaaagcaattctaaatattttttttcttagtcgtagtgcaaaagtatattctctccctttctctatagttttctctcattttgtcttcagacctagaagcatgagagcccagctgtcaaagtcatctagacccccttcagaaggtcattaaatttgtctatttcacaggattgcaagataaaatacagaatgcccagttaaatttgaacttcggataaacaacaaatttttttttagtataagcatatcccatacaatatttgggatatacttatatttttatattgtttatctgacgttcaagctaactaggcatcctgtatttttcttagctaaatctggcaactgtgctatttcattgaaaacctgaaagtgtacaaagaaggaagaagcagaatctgccatatgagtaatagaagtgagcaggcccaggactccctaagtcaagaaaccaagaggcgtcattacggaaaagagtaactcaccctgtgtgctccttggtagttctccctcagcgatgcccccatgttatgaatggggaaaagttcactgaagggttcatagtgaagaaactttttggatgatttctgttggtgggttttggataccttcaagggatcagaaaataatatacttaggaaattttggtaatgtcatcattactctctacattattattatgacggttacaattgttaaatctaggtggtgggtatgtgggttatattgtacatgatttttaacttgtctgcatgtttgaaattataataaagtcaataaataaattattgagacactcctgtt

SEQ ID NO: 122315 - DNA, 4636 bp, Homo sapiens
  Payload ID: 3965
  Gene Symbol: COBLL1
  Gene Name: cordon-bleu WH2 repeat protein-like 1
  Uniprot ID: Q53SF7
  ENST ID: ENST00000409184
  CDS Start-End: 1-3506
cacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactggga

SEQ ID NO: 122316 - DNA, 575 bp, Homo sapiens
  Payload ID: 3965
  Gene Symbol: COBLL1
  Gene Name: cordon-bleu WH2 repeat protein-like 1
  ENST ID: ENST00000414843
  CDS Start-End: 160-575
gagcctcgcaggggttgccgcttctccattcaagtcctggcttgagagccgagcggcaagagcgcgggccggggaagggaagagtaggagaggaagccgcgagggagaacagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctac

SEQ ID NO: 122317 - DNA, 575 bp, Homo sapiens
  Payload ID: 3965
  Gene Symbol: COBLL1
  Gene Name: cordon-bleu WH2 repeat protein-like 1
  ENST ID: ENST00000445474
  CDS Start-End: 131-575
agctttctttcggttcagcttccccagccggaccccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagagagattgctgggtcatggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccat

SEQ ID NO: 122318 - DNA, 750 bp, Homo sapiens
  Payload ID: 3965
  Gene Symbol: COBLL1
  Gene Name: cordon-bleu WH2 repeat protein-like 1
  ENST ID: ENST00000456693
  CDS Start-End: 71-750
gaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatat

SEQ ID NO: 122319 - DNA, 565 bp, Homo sapiens
  Payload ID: 3965
  Gene Symbol: COBLL1
  Gene Name: cordon-bleu WH2 repeat protein-like 1
  ENST ID: ENST00000439313
  CDS Start-End: 76-565
agcccgcgcagcgccccgcagggcgatggacggccgaaccccgcgcccgcaggacgccccagccagagagcaaaaatgttggagacactggttggaaaattgaaatgctgcattggagaagagagcgatagtcaaaagagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacac

SEQ ID NO: 122320 - DNA, 772 bp, Homo sapiens
  Payload ID: 3965
  Gene Symbol: COBLL1
  Gene Name: cordon-bleu WH2 repeat protein-like 1
  ENST ID: ENST00000452626
  CDS Start-End: 1-772
aagcgctagaggaacaatactgttttatggagactttctggaacagttgagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgca

SEQ ID NO: 122321 - DNA, 549 bp, Homo sapiens
  Payload ID: 3965
  Gene Symbol: COBLL1
  Gene Name: cordon-bleu WH2 repeat protein-like 1
  ENST ID: ENST00000448708
  CDS Start-End: 79-549
aggaccagaaggaggacagcaaaaagtgcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacag

SEQ ID NO: 122322 - DNA, 737 bp, Homo sapiens
  Payload ID: 3965
  Gene Symbol: COBLL1
  Gene Name: cordon-bleu WH2 repeat protein-like 1
  ENST ID: ENST00000444537
  CDS Start-End: 227-737
attcaagtcctggcttgagagccgagcggcaagagcgcgggccggggaagggaagagtaggagaggaagccgcgagggagaacaggcgagctactgtctcctttggaaaagaactgacgcgccgcctgggagctggagcccgcgcagcgccccgcagggcgatggacggccgaaccccgcgcccgcaggacgccccagccaggctcagttattgggacagaggctgatgaagaaagacctgaaggaaggccctagtctgtgtggtctctgtttggaggagctaaaaggggactttttggtcgagagactcagagagaatatccctgccgtaaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagag

SEQ ID NO: 122323 - DNA, 1793 bp, Homo sapiens
  Payload ID: 3965
  Gene Symbol: COBLL1
  Gene Name: cordon-bleu WH2 repeat protein-like 1
  ENST ID: ENST00000456171
  CDS Start-End: 165-1439
attcaagtcctggcttgagagccgagcggcaagagcgcgggccggggaagggaagagtaggagaggaagccgcgagggagaacaggcgagctactgtctcctttggaaaagaaccagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccaggaaacatttaggaggaacactcttgaatctttcatctttaagtgaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaag

SEQ ID NO: 122324 - DNA, 3868 bp, Homo sapiens
  Payload ID: 3965
  Gene Symbol: COBLL1
  Gene Name: cordon-bleu WH2 repeat protein-like 1
  ENST ID: ENST00000629362
  CDS Start-End: 125-3826
ctttcggttcagcttccccagccggaccccaaagacccgaagccctgggggaaggaaattccaacttgctcccggcccacccccgccccgttcctctctccggctcgctgcttccctcgctccaatgccgccgagctggtccccacttatgtgcggccgtgctgcagaggcggcggcgagctcccggactccgggcagggaaatggggcaggcagtgacgcgccgcctgggagctggagcccgcgcagcgccccgcagggcgatggacggccgaaccccgcgcccgcaggacgccccagccaggagagagattgctgggtcatggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagccacttctgttactgtcttcagtaagtcatctttacaagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgtagttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcaga

SEQ ID NO: 122325 - DNA, 6078 bp, Homo sapiens
  Payload ID: 3966
  Gene Symbol: C1GALT1
  Gene Name: core 1 synthase, glycoprotein-N-acetylgalactosamine 3-beta-galactosyltransferase 1
  Uniprot ID: Q9NS00
  ENST ID: ENST00000223122
  CDS Start-End: 63-1154
tacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattatcatgggccttgactatattatatacttgattctaattagtcatcttttacgcaatctctgttgtctcttttctaaatgtgtttagccactcttgaataccattctccactattaacattaatttactcaaaccgttcatagcattctgtaaacatgtattttacatatttgttcccaaatttgcccattgttcattatgggtaactaataataaatttaatgctgtttcaggatgcttttcttataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttggtgctattttgggataattgttttgctaatggataattctaacaatgcagaatacctagtcaagactgtcatcaaaaacattcacaaatgtttcattctatttttagtgactctgtttaaagagtttctgaaaggaaagaaattttttatttttattatctttagcagtactgagtgtcatagcagaatattttacagactttctatgagattatttttatggtacaaagtatttacatttccctcatgtttatcattatgccaattttacatggcagtcatgccactgactctgctatttagctaagtaatttcttttttcggagactgtctcactctgtctcccaggctggactgcagtggtgcgattctcctgcctcagcctcccgagtagcggggattacaggcacgcgctgccacgccccgccagttttcatatttttagtagagacagggttttgccgtgttggccaggctggtcttgaactcctgacctcaggtgatccacccaccttggcatcccaaagtgctgggattacgagcgtgagtcacagcacccggctaagtaatttctatttattgtgccaaaacatgtcaaaatcatgacctctttgaatggtatatttgagaggatgttcatttcattggttaaccatggactactctgtccacgtagtgaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattagggatgataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgcccaattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttgtttcatctgattatttttaaccaatataaaa

SEQ ID NO: 122326 - DNA, 930 bp, Homo sapiens
  Payload ID: 3966
  Gene Symbol: C1GALT1
  Gene Name: core 1 synthase, glycoprotein-N-acetylgalactosamine 3-beta-galactosyltransferase 1
  Uniprot ID: Q9NS00
  ENST ID: ENST00000402468
  CDS Start-End: 1-930
atggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatgtcaatacttggactga

SEQ ID NO: 122327 - DNA, 6235 bp, Homo sapiens
  Payload ID: 3966
  Gene Symbol: C1GALT1
  Gene Name: core 1 synthase, glycoprotein-N-acetylgalactosamine 3-beta-galactosyltransferase 1
  Uniprot ID: Q9NS00
  ENST ID: ENST00000436587
  CDS Start-End: 224-1315
agcgggcgggagcgcgcgctgggcccgccttggccgccgccgctgtgctgccgctgccggggaataatctgggcggcagcgggcggcctcggctagcggccacgagccacttctgcggctgcccagagaagcaaaggtcaccagtcccaagtcgtccccctctccgccccccaggaggggcgagagggagccgcagctgatgtcagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattatcatgggccttgactatattatatacttgattctaattagtcatcttttacgcaatctctgttgtctcttttctaaatgtgtttagccactcttgaataccattctccactattaacattaatttactcaaaccgttcatagcattctgtaaacatgtattttacatatttgttcccaaatttgcccattgttcattatgggtaactaataataaatttaatgctgtttcaggatgcttttcttataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttggtgctattttgggataattgttttgctaatggataattctaacaatgcagaatacctagtcaagactgtcatcaaaaacattcacaaatgtttcattctatttttagtgactctgtttaaagagtttctgaaaggaaagaaattttttatttttattatctttagcagtactgagtgtcatagcagaatattttacagactttctatgagattatttttatggtacaaagtatttacatttccctcatgtttatcattatgccaattttacatggcagtcatgccactgactctgctatttagctaagtaatttcttttttcggagactgtctcactctgtctcccaggctggactgcagtggtgcgattctcctgcctcagcctcccgagtagcggggattacaggcacgcgctgccacgccccgccagttttcatatttttagtagagacagggttttgccgtgttggccaggctggtcttgaactcctgacctcaggtgatccacccaccttggcatcccaaagtgctgggattacgagcgtgagtcacagcacccggctaagtaatttctatttattgtgccaaaacatgtcaaaatcatgacctctttgaatggtatatttgagaggatgttcatttcattggttaaccatggactactctgtccacgtagtgaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattagggatgataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgcccaattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttgtttcatctgattatttttaaccaatat

SEQ ID NO: 122328 - DNA, 802 bp, Homo sapiens
  Payload ID: 3966
  Gene Symbol: C1GALT1
  Gene Name: core 1 synthase, glycoprotein-N-acetylgalactosamine 3-beta-galactosyltransferase 1
  ENST ID: ENST00000429911
  CDS Start-End: 409-802
gtcaaaatattggatttactctcagagtttctatcctgctcaatttgaattttcttcacggaagtgttttcctcaggaaagatattttattggctatttctgagttatttgagtacataagccacccagtaccttctgatcttcccattttctcttagtgtgtggctgagatatttttattctactcagccataaattggagtcagaagccttctcctttttactgttattttcacaatatttacttgctgagaatcccactcaagctgctaaaactaggcatgctctgtatgagttctactgctgttgtctgtggtttgggtggggcaaaacccactggcattctgaggctcatggggatgttttttcagttggctttctggaggatgtgaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctg

SEQ ID NO: 122329 - DNA, 591 bp, Homo sapiens
  Payload ID: 3966
  Gene Symbol: C1GALT1
  Gene Name: core 1 synthase, glycoprotein-N-acetylgalactosamine 3-beta-galactosyltransferase 1
  ENST ID: ENST00000419721
  CDS Start-End: 292-591
agacttcgggtggcggctgcgccataggcgggccacggcctggacgcgctgcggggaggggcggagcgagcgggcgggagcgcgcgctgggcccgccttggccgccgccgctgtgctgccgctgccggggaataatctgggcggcagcgggcggcctcggctagcggccacgagccacttctgcggctgcccagagaagcaaaggtcaccagtcccaagtcgtccccctctccgccccccaggaggggcgagagggagccgcagctgatgtcagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaaccta

SEQ ID NO: 122330 - DNA, 3136 bp, Homo sapiens
  Payload ID: 3967
  Gene Symbol: CBFB
  Gene Name: core-binding factor, beta subunit
  Uniprot ID: Q13951
  ENST ID: ENST00000290858
  CDS Start-End: 262-810
gcggtgagcgctggggctgcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 122331 - DNA, 2971 bp, Homo sapiens
  Payload ID: 3967
  Gene Symbol: CBFB
  Gene Name: core-binding factor, beta subunit
  Uniprot ID: Q13951
  ENST ID: ENST00000412916
  CDS Start-End: 164-727
agactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgttt

SEQ ID NO: 122332 - DNA, 509 bp, Homo sapiens
  Payload ID: 3967
  Gene Symbol: CBFB
  Gene Name: core-binding factor, beta subunit
  ENST ID: ENST00000564034
  CDS Start-End: 230-509
caacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgtatatttgaaggctcccatgattctgaatggagtctgtgttatctggaaaggctggattgatctccaaagactggatggtatgggctgtctggagtttgatgaggagcgagccc

SEQ ID NO: 122333 - DNA, 545 bp, Homo sapiens
  Payload ID: 3967
  Gene Symbol: CBFB
  Gene Name: core-binding factor, beta subunit
  ENST ID: ENST00000563939
  CDS Start-End: 362-545
aaaatgcgaaaccagatgccgcgggccggtactcgcggggagacgcttttcctggggctcgccgcggtggcgcgtgtcggccaacggagcaccgcgagtggagctcgaacccgagccagactaaacaagcgaagggcattgtttaggcggcgacaccgaagaagggttcagggtatttgtagcaagcaaacccccattcggaaaaagaagtggagcttcattcaaggcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcggg

SEQ ID NO: 122334 - DNA, 584 bp, Homo sapiens
  Payload ID: 3967
  Gene Symbol: CBFB
  Gene Name: core-binding factor, beta subunit
  ENST ID: ENST00000561924
  CDS Start-End: 257-505
gtggcggcggcggcggcggcggcggccgggggcgattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctagtcctggttccaatttaggtggtggtgatgacctcaaacttcgttaattaatagcacagcagatgtgtgctgcccatctt

SEQ ID NO: 122335 - DNA, 846 bp, Homo sapiens
  Payload ID: 3967
  Gene Symbol: CBFB
  Gene Name: core-binding factor, beta subunit
  ENST ID: ENST00000565389
  CDS Start-End: 1-181
taggaagctgagccgcgagtgtgagattaagtacacgggcttcagggaccggccccacgaggaacgccaggcacgcttccagaacgcctgccgcgacggccgctcggaaatcgcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagaca

SEQ ID NO: 122336 - DNA, 7737 bp, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENST ID: ENST00000346541
  CDS Start-End: 538-2352
ggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 122337 - DNA, 1181 bp, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENST ID: ENST00000344201
  CDS Start-End: 368-1159
ggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagagctgcataatacatctaaaatctatgggagtagcttccagacatgagtatttttcgggaactcttcagatgcctgcacacccggtaagaaactctactctagagaatttatgggtcgactgttccagaagcctcaggagtacagttctgccttttccttgatgctgtttgtagaaagaattgg

SEQ ID NO: 122338 - DNA, 2864 bp, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENST ID: ENST00000342704
  CDS Start-End: 182-1969
aacggcggcggcggcggcggcgacggcgacagcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtca

SEQ ID NO: 122339 - DNA, 7274 bp, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENST ID: ENST00000359606
  CDS Start-End: 40-1884
cgcctgccaccatgcccagctaatttttgtttagtagagatggggtttcaccatgttggccaggctcgtcttgaactcctgacctcaggtgatctgcctgcattggcctcccaacgtgctgggattacagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattccttttctg

SEQ ID NO: 122340 - DNA, 7617 bp, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENST ID: ENST00000375279
  CDS Start-End: 413-2227
agcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattccttttctg

SEQ ID NO: 122341 - DNA, 7449 bp, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENST ID: ENST00000397800
  CDS Start-End: 337-2064
ggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 122342 - DNA, 7803 bp, Homo sapiens
  Payload ID: 3968
  Gene Symbol: CBFA2T2
  Gene Name: core-binding factor, runt domain, alpha subunit 2
  translocated to, 2
  Uniprot ID: O43439
  ENST ID: ENST00000492345
  CDS Start-End: 686-2413
gagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagggtctcaccctgtcactcaggctggagcacagtggtgtgatcacagctcactgcagcctcgacctcctggactcagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattccttttctg

SEQ ID NO: 122343 - DNA, 3502 bp, Homo sapiens
  Payload ID: 3968
  Gene Symbol: CBFA2T2
  Gene Name: core-binding factor, runt domain, alpha subunit 2
  translocated to, 2
  ENST ID: ENST00000543126
  CDS Start-End: 1000-1458
gtattttgggacttcacattcacattctcattgggctgaggctcaaacatatggaatgtgttattttgcagcgtctacattagggaaatcaagcagggcattggtgatgggaggaagtgaacaggaaccaggtaggatgatggtaagtggacagggtttaaaaacccagggcttttggcagtctgcccaaatctatgtctttagcccttgtttgtgcacctagtcttatttatttaattgcctcctggccatttacacctggatgccccagaggcacctccaccttctcacttgcctccacactagctttgtgtggactgtccatttcattgcctagctttagcattcttctctttcacctccacttccaggcccttcggtgctcccaacctttttctgcctcatcccttcctcagtgccacttattcctgcctaaattcagcctcttctatcagttcaatcattgcaccagcctcccggttgctatctctgtctttaatcttccccttgcatagaatcctttatggagtttcctttgaaaataaagtcaagccgactgggcacggtggctcatgcctgtaatcccagcactttgggaggccaaggtgggcggatcacgaggtcaagagatcgagaccatcctggctaacatggtgaaaccctgtctctattaaaaatacaaaaaattagccaggtgtggtggcgggcacctgtagtcccagctactcaggaggctgaggcaggagaatggcgtgaacccgggaggcggagcttgcagtgagcagagattacgccactgcactccagcctgggcaacagagcgggactccgtcgcaaaaaaaaaaaaagaaaataagttcaagccgggggtggtgcctcacccctataacactttaacaccaacgctttgggaggctgaggtaggaggatcacttgagcgcaggagttcgagacaagccttagcaacataaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctct

SEQ ID NO: 122344 - DNA, 4477 bp, Homo sapiens
  Payload ID: 3969
  Gene Symbol: CBFA2T3
  Gene Name: core-binding factor, runt domain, alpha subunit 2
  translocated to, 3
  Uniprot ID: O75081
  ENST ID: ENST00000268679
  CDS Start-End: 398-2359
ccggaatggcccgagggaaggccgcgcagggcagggccccagatggttcctgtcagggaagtggcgggcgcagctgcaggcctccggccccggcattatcacggggacacagctggctgcctcacccgcaggctgcagggagaccttccccagcctgcagccccaggcccgccccgcgtcacatgagccccagggctcccaccccctccccagggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgca

SEQ ID NO: 122345 - DNA, 4033 bp, Homo sapiens
  Payload ID: 3969
  Gene Symbol: CBFA2T3
  Gene Name: core-binding factor, runt domain, alpha subunit 2
  translocated to, 3
  Uniprot ID: O75081
  ENST ID: ENST00000327483
  CDS Start-End: 212-1915
ggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgca

SEQ ID NO: 122346 - DNA, 399 bp, Homo sapiens
  Payload ID: 3969
  Gene Symbol: CBFA2T3
  Gene Name: core-binding factor, runt domain, alpha subunit 2
  translocated to, 3
  ENST ID: ENST00000564416
  CDS Start-End: 214-399
gcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatg

SEQ ID NO: 122347 - DNA, 1327 bp, Homo sapiens
  Payload ID: 3969
  Gene Symbol: CBFA2T3
  Gene Name: core-binding factor, runt domain, alpha subunit 2
  translocated to, 3
  ENST ID: ENST00000569464
  CDS Start-End: 72-1327
tctaaagctgcgaggcccgcggccgccgactgctgcgagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctaggaaaacacgggctggtctgccaggaagcctggagctc

SEQ ID NO: 122348 - DNA, 664 bp, Homo sapiens
  Payload ID: 3969
  Gene Symbol: CBFA2T3
  Gene Name: core-binding factor, runt domain, alpha subunit 2
  translocated to, 3
  ENST ID: ENST00000563640
  CDS Start-End: 274-664
cccgcaggctgcagggagaccttccccagcctgcagccccaggcccgccccgcgtcacatgagccccagggctcccaccccctccccagggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgt

SEQ ID NO: 122349 - DNA, 284 bp, Homo sapiens
  Payload ID: 3969
  Gene Symbol: CBFA2T3
  Gene Name: core-binding factor, runt domain, alpha subunit 2
  translocated to, 3
  ENST ID: ENST00000570046
  CDS Start-End: 218-284
gcgggatcctgtgtccagctcttccactcgcccgtgttttctgggtccatccccactggagcgtgtgtcggacctgccttccttcttatgtctgaataagtgtgcactgcatctgcttttgagtttatctgtgctcggctgacagtctatggagaaccttgtctcaccacagctgtgtgtctcagccccagtggacaggaaagctaaggcctcagcgatgccggactccccagcggaggtgaagacgcagccccggtccacaccccccagcatgccgcccccac

SEQ ID NO: 122350 - DNA, 539 bp, Homo sapiens
  Payload ID: 3969
  Gene Symbol: CBFA2T3
  Gene Name: core-binding factor, runt domain, alpha subunit 2
  translocated to, 3
  ENST ID: ENST00000562719
  CDS Start-End: 143-539
caccagcgccttgagcgttttcctgccgtctccggacacagctggccctgggtggagcttctcagacttcagggagcctcagaccacgagggaatcttgttcagctgcagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccag

SEQ ID NO: 122351 - DNA, 469 bp, Homo sapiens
  Payload ID: 3969
  Gene Symbol: CBFA2T3
  Gene Name: core-binding factor, runt domain, alpha subunit 2
  translocated to, 3
  ENST ID: ENST00000569443
  CDS Start-End: 107-469
gttcagcctcccgcgcggccgccagaagccgcggttctaaagctgcgaggcccgcggccgccgactgctgcgagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtg

SEQ ID NO: 122352 - DNA, 284 bp, Homo sapiens
  Payload ID: 3969
  Gene Symbol: CBFA2T3
  Gene Name: core-binding factor, runt domain, alpha subunit 2
  translocated to, 3
  ENST ID: ENST00000566868
  CDS Start-End: 1-103
cggtcccgaagggcctcagctaggaaaacacgggctggtctgccaggaagcctggagctcagagcgtctggtgggccagaggctcggagctgggaggccctgagggtctctgcttctccgcctcagcgacgaatgctgacacaggagaggcccaggacacacacggctcccagccgagtccaagacgtgcctcgcgagttcctgccgaggaccctcaccggctacgtgcctgaggacatctggaggaaggctgaagaggccgtgaatgaggtgaagcggcaggc

SEQ ID NO: 122353 - DNA, 1921 bp, Homo sapiens
  Payload ID: 3970
  Gene Symbol: CIR1
  Gene Name: corepressor interacting with RBPJ, 1
  Uniprot ID: Q86X95
  ENST ID: ENST00000342016
  CDS Start-End: 94-1446
cttgctgctggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactataagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtacattgaatgggtataatttacttttttcaattcaaatttgttattctaggatttgaatttgcttgaagtgaattgtaataattattcaaattcattagtataaattaaggattaataaatctttaagacttttaa

SEQ ID NO: 122354 - DNA, 561 bp, Homo sapiens
  Payload ID: 3970
  Gene Symbol: CIR1
  Gene Name: corepressor interacting with RBPJ, 1
  ENST ID: ENST00000377973
  CDS Start-End: 1-289
tgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcaggccgggcacagtggctcacgcctgtaatcccagcactttgggaggccaaggctggtggatcatttgaggtcaggagttcgagaccagcctgaccaacatgatgaaaccccgtctctactgaaatacaaaaattagccgggttttgtggccagcgcctgtaatcacagctgctgggaggctgaggcaggagaatcgcttgaacccaggaggtggaagttgcagtgagctgagatggtgtcattgcacttcagcctgggcgatagagcaagattccctctcaaaaaaataaaaataaataaaaataaaatatcttcattgtgtaaggcaaagtttctaataaacagtgattttttttactagcata

SEQ ID NO: 122355 - DNA, 4852 bp, Homo sapiens
  Payload ID: 3971
  Gene Symbol: CORIN
  Gene Name: corin, serine peptidase
  Uniprot ID: Q9Y5Q5
  ENST ID: ENST00000273857
  CDS Start-End: 1-3129
atgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatca

SEQ ID NO: 122356 - DNA, 2417 bp, Homo sapiens
  Payload ID: 3971
  Gene Symbol: CORIN
  Gene Name: corin, serine peptidase
  ENST ID: ENST00000504584
  CDS Start-End: 158-2362
agagcagacaaaatatggggcccctggcgcttaaagttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtggtgagctacttgtttctgccatctgttgtactctctcatgcctgtcagccactgaagctgaatggatcctaaattacttcctggattttactgaccaagttcatctattttgttttactgttataaaagctgatagtgctgatctatgtgtgttatttccaactcacagaaaatttccccacgaagctacttctctatttgaaatatctatattgtatggaaaaacgtttgggttcaaaatgttgtaatcatataattgctgggagaggatttaaaaactcttcattaaaacccaacttcaat

SEQ ID NO: 122357 - DNA, 3112 bp, Homo sapiens
  Payload ID: 3971
  Gene Symbol: CORIN
  Gene Name: corin, serine peptidase
  ENST ID: ENST00000502252
  CDS Start-End: 124-3051
agttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgt

SEQ ID NO: 122358 - DNA, 3018 bp, Homo sapiens
  Payload ID: 3971
  Gene Symbol: CORIN
  Gene Name: corin, serine peptidase
  ENST ID: ENST00000505909
  CDS Start-End: 1-3018
atgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaa

SEQ ID NO: 122359 - DNA, 3200 bp, Homo sapiens
  Payload ID: 3971
  Gene Symbol: CORIN
  Gene Name: corin, serine peptidase
  ENST ID: ENST00000508498
  CDS Start-End: 250-2961
ttttacttggctgtctcaccacagccagccccatgaagaggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagact

SEQ ID NO: 122360 - DNA, 4696 bp, Homo sapiens
  Payload ID: 3971
  Gene Symbol: CORIN
  Gene Name: corin, serine peptidase
  ENST ID: ENST00000610355
  CDS Start-End: 158-2974
agagcagacaaaatatggggcccctggcgcttaaagttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatc

SEQ ID NO: 122361 - DNA, 2549 bp, Homo sapiens
  Payload ID: 3972
  Gene Symbol: CDSN
  Gene Name: corneodesmosin
  Uniprot ID: Q15517
  ENST ID: ENST00000259726
  CDS Start-End: 28-1614
atcagtcaggaggccgtgcagtccgagatgggctcgtctcgggcaccctggatggggcgtgtgggtgggcacgggatgttggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccagacctttggggtatccagcagtggccaaagcgtcagctccaaccagcgtccctgtagttcggacatccccgactctccctgcagtggagggcccatcgtctcgcactccggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcattccagccagtggggactggtggggtccagctctgtggaggcggctccacgggctccaagggaccctgctctccctccagttctcgagtccccagcagttctagcatttccagcagctccggtttaccctaccatccctgcggcagtgcttcccagagcccctgctccccaccaggcaccggctccttcagcagcagctccagttcccaatccagtggcaaaatcatccttcagccttgcggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagaagtcaactgttgtgtgtgtgcatgccttgggcacaaacaagcacatacactatatcccatatgggagaagtccagtgcccaggcatagggttagctcagtttccctccttcccaaaagagtggttctgctttctccactaccccaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgtggaaatggtccattgagtaacacccccatcagcttctcaactgggaaacccctgaaatgctctcagagcacctctgacgcctgaagaagttataccttcctcttcccctttaccaaataaagcaaagtcaaaccatcatctggaaacagtggccacttttcactgacctttcttcgacatctagtcaacccacccaatatgccactgggctctcgctcccaattccaccccaccctccattacagagctcaccacgccctcctagatcaccgtccccaacacacccattgcctctcaaggcccttatctcagccccttcctgtggccacttccctcagtgctcagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcctcctacgcctctagaggtctctgtgttcctcattttccttcaaaagcgggctgtatttctcttctaccttccagctcctcccacagaggaggaagacaataaatatttgttgaactgaaa

SEQ ID NO: 122362 - DNA, 2552 bp, Homo sapiens
  Payload ID: 3972
  Gene Symbol: CDSN
  Gene Name: corneodesmosin
  ENST ID: ENST00000376288
  CDS Start-End: 28-1617
atcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccttgtaaggaccccacgcgtatcacctcccctaacgacccctgcctcactgggaagggtgactccagcggtttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaaacagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccagacctttggggtatccagcagtggccaaagcgtcagctccaaccagcgtccctgtagttcggacatccccgactctccctgcagtggagggcccatcgtctcgcactccggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcattccagccagtggggactggtggggtccagctctgtggaggcggctccacgggctccaagggaccctgctctccctccagttctcgagtccccagcagttctagcatttccagcagctccggtttaccctaccatccctgcggcagtgcttcccagagcccctgctccccaccaggcaccggctccttcagcagcagctccagttcccaatccagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcaacagtccataagaagtcaactgttgtgtgtgtgcatgccttgggcacaaacaagcacatacactatatcccatatgggagaagtccagtgcccaggcatagggttagctcagtttccctccttcccaaaagagtggttctgctttctccactaccccaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgtggaaatggtccattgagtaacacccccatcagcttctcaactgggaaacccctgaaatgctctcagagcacctctgacgcctgaagaagttataccttcctcttcccctttaccaaataaagcaaagtcaaaccatcatctggaaacagtggccacttttcactgacctttcttcgacatctagtcaacccacccaatatgccactgggctctcgctcccaattccaccccaccctccattacagagctcaccacgccctcctagatcaccgtccccaacacacccattgcctctcaaggcccttatctcagccccttcctgtggccacttccctcagtgctcagatgattccctgggtgagggagacactggggcaccctcagaggttgaagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgttcctcattttccttcaaaagcgggctgtgtttctcttctaccttccagctgctcccacagaggaggaagacaataaatatttgttgaactgaaa

SEQ ID NO: 122363 - DNA, 2549 bp, Homo sapiens
  Payload ID: 3972
  Gene Symbol: CDSN
  Gene Name: corneodesmosin
  ENST ID: ENST00000383531
  CDS Start-End: 28-1617
atcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctttggggtatccagcagtggccaaagcgtcagctccaaccagcgtccctgtagttcggacatccccgactctccctgcagtggagggcccatcgtctcgcactctggcccctacatccccagctcccactctgtgtcagggggtcagagacctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagcgccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaagtccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggaatcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaa

SEQ ID NO: 122364 - DNA, 2503 bp, Homo sapiens
  Payload ID: 3972
  Gene Symbol: CDSN
  Gene Name: corneodesmosin
  Uniprot ID: Q15517
  ENST ID: ENST00000445893
  CDS Start-End: 28-1617
atcagtcaggaggccgtgcagcccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctctggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccag

SEQ ID NO: 122365 - DNA, 2536 bp, Homo sapiens
  Payload ID: 3972
  Gene Symbol: CDSN
  Gene Name: corneodesmosin
  Uniprot ID: Q15517
  ENST ID: ENST00000418599
  CDS Start-End: 15-1604
ccgtgcagcccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctttggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaa

SEQ ID NO: 122366 - DNA, 2549 bp, Homo sapiens
  Payload ID: 3972
  Gene Symbol: CDSN
  Gene Name: corneodesmosin
  Uniprot ID: Q15517
  ENST ID: ENST00000457875
  CDS Start-End: 28-1617
atcagtcaggaggccgtgcagcccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctctggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaa

SEQ ID NO: 122367 - DNA, 4793 bp, Homo sapiens
  Payload ID: 3973
  Gene Symbol: CNIH1
  Gene Name: cornichon family AMPA receptor auxiliary protein 1
  Uniprot ID: O95406
  ENST ID: ENST00000216416
  CDS Start-End: 105-539
cggtcgcggctgtggccgggggaagtgaatggttttacccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactcactttcagtgcattgtttgagattaaaaatagtatttcttaaacttgcttaatccatgataaagacatgttgctgtcatttttaaaaagtgacgtactacattatgggttttctgaaaaataccatgcctagatctaaaaaggaaaatttttaaatgccgagcacattaacctcttttgtcatttgacaagattcataaacgtggatggcatagcatcatcatttctcttaccaattaagaaaaattatggtggcacttaaaatattttactttgatttttcctttttggaacagtcagttttaaggtaaaatggcttgtaaatttgagtttttgctgctgcttgtaaggcaggtaaattatggcttgcatgttttcataagcataaataaatcttgtgctttatttgggatgaggaagttaaggcagttgaaaataaaataagtggtttggaagtttcttgagaagaggatcaaaagaaagagaaccaatatatagaaatttcacatgatcaaggaagtttatggatgcgtttgtggaaatcttactctatgaacttgttggattagatgctgttttattctctactaagtgaaaagtgctttatttcagtgctttcccatggttgggagagagtagctgttaactattctgggtaatgggggtgagtatgttgaggaagagatttagaaccagaagagtgaagagactcaaactgttccataacaaggaaagctttaaagaccttgtatttcacagtctggagaactagagggatctgactcttggtcagttcatgtaacaaattatttattgagtacttgctgggctctcaagattcatgctttgagcacaggcagtcattcagtttccagtccacctgattacatcagcatgcacttagttttctttcttgttcacaaggacttttgatcatgcaagacctggccaagtcttctataatccagatgggtttcctggggctgttacttgagtattcctgtcaaaatattttcgtgaaccctgcctctcttagcaaacactacttcataagtgttaacaaacatccttttaataatctattccagaatattctccaggagtaagtttactggttgggatttgtggaagccattttctcatgtttcccaaataagatatgtagtcttcagctgattcctcaaagatgattgacagggagtttcacccatctttgtggtagtttgtgagttcctaggcatgtaagtgattaaaagattgagtacctgctctcctaatatctacccacttttaccatgtcagtgttttatgaattagatcacttaccaagagaaagcagaaacgaaatacttgaatctgacaatatccgactggctcttttcattgctctggatttattttccacatcaatctctttggggtggccctagcctattattcctgtgggttcagctgaggcatggttagcctgggtttataattcagtttacgttaaacattccctgtgcagcaacagctgttcatttaggtactctttttttttttctccttattacagttacttttggtattatgtgctttatctttaaaagctttctagctctaggaaattgttttccctgtttgtgtctattttattgcatcttgtgtaacactgtggttatatctataccaacaactttttgttgctatggataccacagattgtcctgaattaaaaccctaacataataaatgtctgtttagccgttactttactgagtaataatactatattgtggcagtatggccctttaatactaaggaggtatggtgtagaaattatttgaacactcatatccaaatgttattaatgatgtttgacagttttctcaatgcttaatgatattcctcactcctcattccagggtagaggagggtttggtcccaggctatggacaaactgctaatttgtttgaagtttgaattatttttcatgggaaagggaagtgataggaaatgaccaagaccatccacttttgacttgagtatggatcgagtataagtaatagtttcctagcctcactgattgtaccatgaactgacagacctaccagtcaaattcatgtacccagataatggtctctcacatggcaacaaagtacacagcagtttgcagtatgtgtctcttttaaagccagttcagtgttttcaccttgacgaccactcctgcaaacagttctcatagagctcttctctgctccccaaatcaatatattttgaagctatgtcaaatatttacatagaaaggaaataaagttgtatgtgctttgaaaccagcaaaatcctttgtacaacacctctcttctccttctatgtttatgaatagagttcgtggaatattgccatagtgcaaataatgacttccgtgtatcacttataccctgtaggggtgagctttcaccttaggtgtggttatatcctagcagtgtatcaagcccactcaaataatggtctatatttaaaagtatgtgtctagtttacttatttatgtcatttaacatccataaatgtacatctctcagttgtatatcatgattgtaaatcagaaattttgatggcaaaaatattctaaaacaacattcttcaggggaaagaaaaacatggataccttatctagcattgctcataaaagtactcatgttcatcctttttggaaactattaatcatgctagccttagatcattttaagctcctttgctcaaaccaatcattgatgtgcagtatgaccagcagctagtaagtctgtggtgctaccagtatagcttggaagatggttctgaattaatacctcagaatgatatcaaaagtaaaagagtggttctattgctaaatatattgactagctttcttataacaattttactttgaaattcaaagttccaaagctaaatgtctaaaagaagtaactgcagcttgttctgctgattttggaaaatagtattaaccatgtaagatctttggggttggagtgaaggtcttatctgcattaattttgttaatgcacattgtagatgtggagaacatcttgacctgcataaggattgcgtctcattttattgtgtagtgctttttcgaaatatttacatttctttggttcccatgttcatgtattctggagaagtaaaatttcttgattactgggcagaccctaaaactactaagagaaacataacatgtagttagctgtctgctcatggtttgttcaaatctaagctaaccttaatggtgctgtgtccgctgtccacagaaaacgcccttaagtagccctaccttactccttagagcttattttgcttttgtatttaataaaagctgtcttaaatgttt

SEQ ID NO: 122368 - DNA, 1233 bp, Homo sapiens
  Payload ID: 3973
  Gene Symbol: CNIH1
  Gene Name: cornichon family AMPA receptor auxiliary protein 1
  ENST ID: ENST00000395573
  CDS Start-End: 65-355
agagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggagcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaatt

SEQ ID NO: 122369 - DNA, 523 bp, Homo sapiens
  Payload ID: 3973
  Gene Symbol: CNIH1
  Gene Name: cornichon family AMPA receptor auxiliary protein 1
  ENST ID: ENST00000556113
  CDS Start-End: 14-424
ctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatgggtaagttgaaaaggtaaaatgaaatatgctttcactttgctgctttaaaagtttgcaggcattatggttttcacacctcaaaatccatttgaagaataactta

SEQ ID NO: 122370 - DNA, 856 bp, Homo sapiens
  Payload ID: 3973
  Gene Symbol: CNIH1
  Gene Name: cornichon family AMPA receptor auxiliary protein 1
  ENST ID: ENST00000557659
  CDS Start-End: 50-211
gcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatcccgtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatg

SEQ ID NO: 122371 - DNA, 838 bp, Homo sapiens
  Payload ID: 3973
  Gene Symbol: CNIH1
  Gene Name: cornichon family AMPA receptor auxiliary protein 1
  ENST ID: ENST00000557690
  CDS Start-End: 65-547
agagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatcccacagttgaaaaggtcaaaaagattaaaagagtcaaaattgcattaaagcttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatc

SEQ ID NO: 122372 - DNA, 785 bp, Homo sapiens
  Payload ID: 3973
  Gene Symbol: CNIH1
  Gene Name: cornichon family AMPA receptor auxiliary protein 1
  ENST ID: ENST00000553660
  CDS Start-End: 31-396
ggcgccgctccccgctcctcctccccagccatggcgttcacgttcgcggccttctgctacatgctggcgctgctgctcactgccgcgctcatcttcttcgccatttggcaccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatc

SEQ ID NO: 122373 - DNA, 787 bp, Homo sapiens
  Payload ID: 3973
  Gene Symbol: CNIH1
  Gene Name: cornichon family AMPA receptor auxiliary protein 1
  ENST ID: ENST00000554683
  CDS Start-End: 18-119
gctcctcctccccagccatggcgttcacgttcgcggccttctgctacatgctggcgctgctgctcactgccgcgctcatcttcttcgccatttggcacgataaagaggaatttggataaacagttgaaattatttttctactcagaagattatttcgagtagagataagttgaaataacttgagcagaggcattgacgaaattgaaaattgaagattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtat

SEQ ID NO: 122374 - DNA, 1356 bp, Homo sapiens
  Payload ID: 3974
  Gene Symbol: CNIH2
  Gene Name: cornichon family AMPA receptor auxiliary protein 2
  Uniprot ID: Q6PI25
  ENST ID: ENST00000311445
  CDS Start-End: 259-741
gagcgagggagccgcgggcgagggatcgcaggatgagcgatcggggcccgggcagccggcagcggacgcgccccccgagcccaccggcccgcgccccgcgccccccacggccccgcggtcccggtcccggccgcatcacccacgtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaacccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataaactactgcaaatatgtggg

SEQ ID NO: 122375 - DNA, 1524 bp, Homo sapiens
  Payload ID: 3974
  Gene Symbol: CNIH2
  Gene Name: cornichon family AMPA receptor auxiliary protein 2
  ENST ID: ENST00000528852
  CDS Start-End: 268-726
cgggctggagagcgagggagccgcgggcgagggatcgcaggatgagcgatcggggcccgggcagccggcagcggacgcgccccccgagcccaccggcccgcgccccgcgccccccacggccccgcggtcccggtcccggccgcatcacccacgtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacaggtgaggccttgcccacagcagtcagaactcagggaagggatgtcccagcatcacgcttccaatcccaagttcctgccttttgcccctgaggactgagggcagcccagggtgtgaccaggtgggcatctgggtggctgtgtgtgtgcagggctaggctcactggctcatcttcctacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaacccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttgtctcttggacctattttctatgtcgcctggaggagtccggcaccccctccccggccatttgtgacaaaatatgaataa

SEQ ID NO: 122376 - DNA, 568 bp, Homo sapiens
  Payload ID: 3974
  Gene Symbol: CNIH2
  Gene Name: cornichon family AMPA receptor auxiliary protein 2
  ENST ID: ENST00000534826
  CDS Start-End: 222-341
cgatcggggcccgggcagccggcagcggacgcgccccccgagcccaccggcccgcgccccgcgccccccacggccccgcggtcccggtcccggccgcatcacccacgtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacgagaagcaccacttagatctcagctgtgactgtcagtgagctcggatttcctgccccaccaatcctgagacatggaccaatcctaagacatggacctgaccaccccactctgctgctgtgtactcttcaatgcctccccccaaaatttttgtgttaaaatcatagcctttgatgagctgcggaccgacttcaagaaccccatcgaccaggggaaccctgcgcgggcacgcgagcgtttaaaaaacatcgaacgcatctgctgcctc

SEQ ID NO: 122377 - DNA, 1142 bp, Homo sapiens
  Payload ID: 3974
  Gene Symbol: CNIH2
  Gene Name: cornichon family AMPA receptor auxiliary protein 2
  ENST ID: ENST00000528063
  CDS Start-End: 116-304
gtcccccgagccccacgggccatgcccggccggccctaagcgcgggccggggggcgtccccttgcgcccgggccccgcgctggcgccccccgggccgccgcccggcgcgggggccatggcgttcaccttcgccgcgttctgctacatgctcaccctggtgctgtgcgcctccctcatcttctttgtcatctggcacatcatagcctttgatgagctgcggaccgacttcaagaaccccatcgaccaggggaaccctgcgcgggcagtaagtgatacatgtgctgtgccgagcgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaagggggaagccggccagggagcgagcccagaacggaccggacgcctgtgcacccccagccctgccccttggccgcagaggcctcagccctggggagggagggggcactggtgcccccagcctctccaacccccaaactgctgctgcggggaaccccccccaccccgccttcagagccctcccccttggactagagcggctgggcagagctctaaacaggggcaggggctcctctgccagcctgtgggcatggcagtcattcctggaaggggcaggacctccggccttgtccatttcgggggaaacttgggccctgccaaggggcagagcttgaccctggaaattctgggccatccccctccacccccaccctgaggctccccctgcaggtgggggggtacccgcaccgggaatgagcaggctcagcaggggggcagccccacccctagtctgccctcccctctcccccaggctctttctccagccctgtctccatctgccccaacctcagcccaccttg

SEQ ID NO: 122378 - DNA, 2558 bp, Homo sapiens
  Payload ID: 3975
  Gene Symbol: CNIH3
  Gene Name: cornichon family AMPA receptor auxiliary protein 3
  Uniprot ID: Q8TBE1
  ENST ID: ENST00000272133
  CDS Start-End: 883-1365
ccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatgccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagctgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtgaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaa

SEQ ID NO: 122379 - DNA, 808 bp, Homo sapiens
  Payload ID: 3976
  Gene Symbol: CNIH4
  Gene Name: cornichon family AMPA receptor auxiliary protein 4
  ENST ID: ENST00000366856
  CDS Start-End: 33-446
gacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 122380 - DNA, 3963 bp, Homo sapiens
  Payload ID: 3976
  Gene Symbol: CNIH4
  Gene Name: cornichon family AMPA receptor auxiliary protein 4
  Uniprot ID: Q9P003
  ENST ID: ENST00000366857
  CDS Start-End: 55-333
gtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatggtaggcaaagtgaacttggctctgctggcctctttggggtcacagaaattgctccttgtggtaatcttatatttctgtcaggcacagggccaagaagctgtgtaacagacattactttgcttgcatctctttttcataccttttccctctgaggcagcttttgcttagaaaacagtcccttcactctgcctttcctcctaacttcctgtgcctcttcatgttctgctcaagctttttaaagcaacgaagctgttggagaacttaaatccttgcaactgagagataagctacttaaaggcggtagagatctttttttttttttttttgagatggggtcttgctgtgttgcccaggctggagtgcagtggtgtgatctcagctcactgcaacctctgctttctgggttcaagcgattctcctgcctcagcctcccaagtagctgggattacggctagctactcctggctaatttttgtatttttagtagagatggggtttcaccatgttggccaggctggtctcaaactcctgacctcaaacgatctgcctgccttggtctcccaaagtgctgggattataggtgtgagccactgcgcctggccatgtagatgacttttgaccaaaatgtttcaccttctcattcagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaattttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 122381 - DNA, 702 bp, Homo sapiens
  Payload ID: 3976
  Gene Symbol: CNIH4
  Gene Name: cornichon family AMPA receptor auxiliary protein 4
  ENST ID: ENST00000366858
  CDS Start-End: 68-340
ctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 122382 - DNA, 4125 bp, Homo sapiens
  Payload ID: 3976
  Gene Symbol: CNIH4
  Gene Name: cornichon family AMPA receptor auxiliary protein 4
  Uniprot ID: Q9P003
  ENST ID: ENST00000465271
  CDS Start-End: 76-495
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatggtaggcaaagtgaacttggctctgctggcctctttggggtcacagaaattgctccttgtggtaatcttatatttctgtcaggcacagggccaagaagctgtgtaacagacattactttgcttgcatctctttttcataccttttccctctgaggcagcttttgcttagaaaacagtcccttcactctgcctttcctcctaacttcctgtgcctcttcatgttctgctcaagctttttaaagcaacgaagctgttggagaacttaaatccttgcaactgagagataagctacttaaaggcggtagagatctttttttttttttttttgagatggggtcttgctgtgttgcccaggctggagtgcagtggtgtgatctcagctcactgcaacctctgctttctgggttcaagcgattctcctgcctcagcctcccaagtagctgggattacggctagctactcctggctaatttttgtatttttagtagagatggggtttcaccatgttggccaggctggtctcaaactcctgacctcaaacgatctgcctgccttggtctcccaaagtgctgggattataggtgtgagccactgcgcctggccatgtagatgacttttgaccaaaatgtttcaccttctcattcagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaattttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacagttatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 122383 - DNA, 523 bp, Homo sapiens
  Payload ID: 3977
  Gene Symbol: CNFN
  Gene Name: cornifelin
  Uniprot ID: Q9BYD5
  ENST ID: ENST00000222032
  CDS Start-End: 51-389
ccgtgtctccacacgtctgcctccatcactgccatcgcgatcctgcagctatgtcctaccctgtgaccagtcagccccagtgcgccaccaccagctgctaccagacccagctcagtgactggcacacaggtctcacggactgctgcaacgacatgcctgtctgtctgtgcggcacttttgctcctctgtgccttgcctgccgcatctccgacgactttggcgagtgctgctgcgcgccctacctgcccggaggcctgcactccatccgcaccggcatgcgggagcgctaccacatccagggctccgtcgggcacgactgggcggccctcaccttttgtctgccctgcgccctctgccagatggcgcgggaactgaagatccgagagtaaggaagttccctgtcttccccgtccttttccaccagtctcgcctctggccttctctggccactcctgggagggactgcctcaccacccctgtcccgctgccagaaatacacccacaataaaaacctgaaaaccaa

SEQ ID NO: 122384 - DNA, 502 bp, Homo sapiens
  Payload ID: 3977
  Gene Symbol: CNFN
  Gene Name: cornifelin
  Uniprot ID: Q9BYD5
  ENST ID: ENST00000597255
  CDS Start-End: 112-450
cctccatcactgccatcgcgatcctgcagccacttctgccgtccccaacgccacctcctcagggccagcaagatgcagtttgagatgcacgacaacgtgaaaggcaaagctatgtcctaccctgtgaccagtcagccccagtgcgccaccaccagctgctaccagacccagctcagtgactggcacacaggtctcacggactgctgcaacgacatgcctgtctgtctgtgcggcacttttgctcctctgtgccttgcctgccgcatctccgacgactttggcgagtgctgctgcgcgccctacctgcccggaggcctgcactccatccgcaccggcatgcgggagcgctaccacatccagggctccgtcgggcacgactgggcggccctcaccttttgtctgccctgcgccctctgccagatggcgcgggaactgaagatccgagagtaaggaagttccctgtcttccccgtccttttccaccagtctcgcctctggccttc

SEQ ID NO: 122385 - DNA, 1902 bp, Homo sapiens
  Payload ID: 3978
  Gene Symbol: CRNN
  Gene Name: cornulin
  Uniprot ID: Q9UBG3
  ENST ID: ENST00000271835
  CDS Start-End: 64-1551
actcctcacaccacttaacagccacttgtttcatcccacctgggcattaggttgacttcaaagatgcctcagttactgcaaaacattaatgggatcatcgaggccttcaggcgctatgcaaggacggagggcaactgcacagcgctcacccgaggggagctgaaaagactcttggagcaagagtttgccgatgtgattgtgaaaccccacgatccagcaactgtggatgaggtcctgcgtctgctggatgaagaccacacagggactgtggaattcaaggaattcctggtcttagtgtttaaagttgcccaggcctgtttcaagacactgagcgagagtgctgagggagcctgcggctctcaagagtctggaagcctccactctggggcctcgcaggagctgggcgaaggacagagaagtggcactgaagtgggaagggcggggaaagggcagcattatgaggggagcagccacagacagagccagcagggttccagagggcagaacaggcctggggttcagacccagggtcaggccactggctctgcgtgggtcagcagctatgacaggcaagctgagtcccagagccaggaaagaataagcccgcagatacaactctctgggcagacagagcagacccagaaagctggagaaggcaagaggaatcagacaacagagatgaggccagagagacagccacagaccagggaacaggacagagcccaccagacaggtgagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacagggacagacccagacgcagccaggcagtggtcaaagatggatgcaagtgagcaaccctgaggcaggagagacagtaccgggaggacaggcccagactggggcaagcactgagtcaggaaggcaggagtggagcagcactcacccaaggcgctgtgtgacagaagggcagggagacagacagcccacagtggttggtgaggaatgggttgatgaccactcaagggagacagtgatcctcaggctggaccagggcaacttgcataccagtgtttcctcagcacagggccaggatgcagcccagtcagaagagaagcgaggcatcacagctagagagctgtattcctacttgagaagcaccaagccatgacttccccgactccaatgtccagtactggaagaagacagctggagagagtttggcttgtcctgcatggccaatccagtgggtgcatccctggacatcagctcttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagccactgg

SEQ ID NO: 122386 - DNA, 3815 bp, Homo sapiens
  Payload ID: 3979
  Gene Symbol: CORO7-PAM16
  Gene Name: CORO7-PAM16 readthrough
  ENST ID: ENST00000575334
  CDS Start-End: 467-2074
cttaaggagtggagtggatgatggaagaggtagatagtgctggaaggcgtgctaggtacaccgcaaagactccacagcaaatcctgcacacaaaatcgcgaatgctgcagccgagaccccacgcaagcaagcaccgcaggagacgtgggctgacagctgcgccccacgtgacctcccacccgcgccagtccgtcccctcggtatcagggcgtggcctcgcggggcggccgtacctggattggccgggaggcgggaccggtggtgcgcgcgcgaaaggagaggggcttgggggcgtggcccagggggccggagacggctgcgattggcagtggggcgcgccgggggcgtgaccgcggcattgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagatgagggagaagaggcacagagaggtttagtgacctgcccgggtcacacagctgtctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggccaagtacctggcccagatcattgtgatgggcgtgcaggtggtgggcagggcctttgcacgggccttgcggcaggagtttgcaggggtgagccaccaactcggaaggcccagggtgaagtgtgggctgctgaggactgagcgatcacccacatgtccacacagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 122387 - DNA, 3284 bp, Homo sapiens
  Payload ID: 3979
  Gene Symbol: CORO7-PAM16
  Gene Name: CORO7-PAM16 readthrough
  ENST ID: ENST00000572467
  CDS Start-End: 70-3216
tgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 122388 - DNA, 3284 bp, Homo sapiens; identical to SEQ ID NO: 122387
  Payload ID: 3979
  Gene Symbol: CORO7-PAM16
  Gene Name: CORO7-PAM16 readthrough
  ENST ID: ENST00000617295
  CDS Start-End: 70-3216

SEQ ID NO: 122389 - DNA, 3815 bp, Homo sapiens; identical to SEQ ID NO: 122386
  Payload ID: 3979
  Gene Symbol: CORO7-PAM16
  Gene Name: CORO7-PAM16 readthrough
  ENST ID: ENST00000632291
  CDS Start-End: 467-2074

SEQ ID NO: 122390 - DNA, 2603 bp, Homo sapiens
  Payload ID: 3980
  Gene Symbol: CORO6
  Gene Name: coronin 6
  Uniprot ID: Q6QEF8
  ENST ID: ENST00000345068
  CDS Start-End: 215-1633
gatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcc

SEQ ID NO: 122391 - DNA, 2397 bp, Homo sapiens
  Payload ID: 3980
  Gene Symbol: CORO6
  Gene Name: coronin 6
  Uniprot ID: Q6QEF8
  ENST ID: ENST00000388767
  CDS Start-End: 3-1421
ctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 122392 - DNA, 1416 bp, Homo sapiens
  Payload ID: 3980
  Gene Symbol: CORO6
  Gene Name: coronin 6
  ENST ID: ENST00000584969
  CDS Start-End: 1-1416
atgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagcaagcccggcctcacgagggcgcccgcccgctgcgggctgtcttcaccgcagacgggaagctgctcagcaccggcttcagcaggatgagtgagcggcaactcgcgctctgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactag

SEQ ID NO: 122393 - DNA, 2345 bp, Homo sapiens
  Payload ID: 3980
  Gene Symbol: CORO6
  Gene Name: coronin 6
  ENST ID: ENST00000580212
  CDS Start-End: 80-1378
ctcctccctcccgcagctcacaggactaaggaccaaaggcatttctgggcactgagatcctacctctctgcctgcagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaa

SEQ ID NO: 122394 - DNA, 868 bp, Homo sapiens
  Payload ID: 3980
  Gene Symbol: CORO6
  Gene Name: coronin 6
  ENST ID: ENST00000492276
  CDS Start-End: 273-868
ggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctcacaggactaaggaccaaaggcatttctgggcactgagatcctacctctctgcctgcagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagacctt

SEQ ID NO: 122395 - DNA, 1581 bp, Homo sapiens
  Payload ID: 3980
  Gene Symbol: CORO6
  Gene Name: coronin 6
  ENST ID: ENST00000480954
  CDS Start-End: 1-88
cgcagacgggaagctgctcagcaccggcttcagcaggatgagtgagcggcaactcgcgctctgggacccgttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaag

SEQ ID NO: 122396 - DNA, 559 bp, Homo sapiens
  Payload ID: 3980
  Gene Symbol: CORO6
  Gene Name: coronin 6
  ENST ID: ENST00000584602
  CDS Start-End: 338-559
aggttgatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagt

SEQ ID NO: 122397 - DNA, 3540 bp, Homo sapiens
  Payload ID: 3981
  Gene Symbol: CORO7
  Gene Name: coronin 7
  Uniprot ID: P57737
  ENST ID: ENST00000251166
  CDS Start-End: 147-2924
gattggcagtggggcgcgccgggggcgtgaccgcggcattgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggcca

SEQ ID NO: 122398 - DNA, 3392 bp, Homo sapiens
  Payload ID: 3981
  Gene Symbol: CORO7
  Gene Name: coronin 7
  Uniprot ID: P57737
  ENST ID: ENST00000537233
  CDS Start-End: 112-2835
gcattgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgca

SEQ ID NO: 122399 - DNA, 563 bp, Homo sapiens
  Payload ID: 3981
  Gene Symbol: CORO7
  Gene Name: coronin 7
  ENST ID: ENST00000572044
  CDS Start-End: 79-563
agtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgt

SEQ ID NO: 122400 - DNA, 3578 bp, Homo sapiens
  Payload ID: 3981
  Gene Symbol: CORO7
  Gene Name: coronin 7
  ENST ID: ENST00000571227
  CDS Start-End: 110-250
attgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagcctgagcaggtggagccccaaagaattgctgagccaggtgccgggagacccttcggacccccgaaacggcaggaggactgatgaggggtgcgccttggaaacgatgtcagctctgctcttccgctttccgtgttattttcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctgagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggc

SEQ ID NO: 122401 - DNA, 1890 bp, Homo sapiens
  Payload ID: 3981
  Gene Symbol: CORO7
  Gene Name: coronin 7
  ENST ID: ENST00000571756
  CDS Start-End: 79-738
agtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctgagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgaggtgagggccccaccccaccagggctgcccctcagttccctgcctgtggcaaagacgcggagggccttagctacccacacaacacagggagcacaaaccttgtgtcaggctcctgcccgcctgtcctgtgatcctcccagccacctgccatggggcctgccacttttatccccattttacagatgagggagaagaggcacagagaggtttagtgacctgcccgggtcacacagctgtgtaagtggtggagctgggatccgaagcccggccacctgagccctaagccggagcttttc

SEQ ID NO: 122402 - DNA, 593 bp, Homo sapiens
  Payload ID: 3981
  Gene Symbol: CORO7
  Gene Name: coronin 7
  ENST ID: ENST00000572898
  CDS Start-End: 110-593
attgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctgagctggcagcccatggggacctggtgcagagcgccgtctggagccgagatggagccct

SEQ ID NO: 122403 - DNA, 578 bp, Homo sapiens
  Payload ID: 3981
  Gene Symbol: CORO7
  Gene Name: coronin 7
  ENST ID: ENST00000571052
  CDS Start-End: 407-578
gagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctg

SEQ ID NO: 122404 - DNA, 1066 bp, Homo sapiens
  Payload ID: 3981
  Gene Symbol: CORO7
  Gene Name: coronin 7
  ENST ID: ENST00000576437
  CDS Start-End: 361-687
ttgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgca

SEQ ID NO: 122405 - DNA, 663 bp, Homo sapiens
  Payload ID: 3981
  Gene Symbol: CORO7
  Gene Name: coronin 7
  ENST ID: ENST00000572549
  CDS Start-End: 47-663
gtacaccgcaaagactccacagcaaatcctgcacacaaaatcgcgaatgctgcagccgagaccccacgcaagcaagcaccgcaggagacgtgggctgacagctgcgccccacgtgacctcccacccgcgccagtccgtcccctcggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgc

SEQ ID NO: 122406 - DNA, 729 bp, Homo sapiens
  Payload ID: 3981
  Gene Symbol: CORO7
  Gene Name: coronin 7
  ENST ID: ENST00000573165
  CDS Start-End: 672-729
ttaggtagactcgccgtgcagaacctcgctattctgtgctagacaaccaatgggtgtacgttatcggtgtaaggacgtggttgaatgtagccgaacttaagtggtccgaggggtctggctaagggcgagactacaagtcccagcatacaacgcggtcctccgtcgcgccgctcccagcatgtagtgcgtggtttcctcctgctgaccctgagacttacgacgaattgcgaagaggtagatagtgctggaaggcgtgctaggtacaccgcaaagactccacagcaaatcctgcacacaaaatcgcgaatgctgcagccgagaccccacgcaagcaagcaccgcaggagacgtgggctgacagctgcgccccacgtgacctcccacccgcgccagtccgtcccctcggtatcagggcgtggcctcgcggggcggccgtacctggattggccgggaggcgggaccggtggtgcgcgcgcgaaaggagaggggcttgggggcgtggcccagggggccggagacggctgcgattggcagtggggcgcgccgggggcgtgaccgcggcattgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcg

SEQ ID NO: 122407 - DNA, 557 bp, Homo sapiens
  Payload ID: 3981
  Gene Symbol: CORO7
  Gene Name: coronin 7
  ENST ID: ENST00000576051
  CDS Start-End: 525-557
agattatgccccacctcttgctttaggcatgcatggaggtggaaccctggctctcaccacatacttctttactcttgattttcagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagcc

SEQ ID NO: 122408 - DNA, 581 bp, Homo sapiens
  Payload ID: 3981
  Gene Symbol: CORO7
  Gene Name: coronin 7
  ENST ID: ENST00000571059
  CDS Start-End: 112-581
gcattgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggcccatgagaacagcagggatagccggctggcatggatgggcacctgggagcaccttgtgtctactggattcaaccagatgcgtgagcgcgaagtgaagctgtgggacacgcggttcttctccagcgccctggc

SEQ ID NO: 122409 - DNA, 730 bp, Homo sapiens
  Payload ID: 3981
  Gene Symbol: CORO7
  Gene Name: coronin 7
  ENST ID: ENST00000576637
  CDS Start-End: 1-358
ttgcagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgt

SEQ ID NO: 122410 - DNA, 540 bp, Homo sapiens
  Payload ID: 3981
  Gene Symbol: CORO7
  Gene Name: coronin 7
  ENST ID: ENST00000570928
  CDS Start-End: 78-422
gtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagagctggcagcccatggggacctggtgcagagcgccgtctggagccgagatggagccctggtgggcacggcgtgcaagacggagtctcagtctgtttcccaggctggagtgtagtggcacgatctcggttcactgcaagctcattgcaacctccgtctcccaggttcaagtgattctcctgactcagcctcccgagtagctgggattacaggacaagcagctgcggatcttt

SEQ ID NO: 122411 - DNA, 501 bp, Homo sapiens
  Payload ID: 3981
  Gene Symbol: CORO7
  Gene Name: coronin 7
  ENST ID: ENST00000570645
  CDS Start-End: 361-501
ttgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagca

SEQ ID NO: 122412 - DNA, 666 bp, Homo sapiens
  Payload ID: 3981
  Gene Symbol: CORO7
  Gene Name: coronin 7
  ENST ID: ENST00000575850
  CDS Start-End: 47-666
gtacaccgcaaagactccacagcaaatcctgcacacaaaatcgcgaatgctgcagccgagaccccacgcaagcaagcaccgcaggagacgtgggctgacagctgcgccccacgtgacctcccacccgcgccagtccgtcccctcgtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggat

SEQ ID NO: 122413 - DNA, 605 bp, Homo sapiens
  Payload ID: 3981
  Gene Symbol: CORO7
  Gene Name: coronin 7
  ENST ID: ENST00000570779
  CDS Start-End: 1-573
gtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggtgagtagtgagtggcctcacttcccggcaggcagcgcggtccctcgcacatgccacggtgcatgcctcctcccttcccaggccctcctgactccctcccacctcttggtgtttcgccccaggactagcctgcgcccccgtcacctccacctcacctgtgctgccacttcctagtgcacacctcacggctcatcctcaagctggaa

SEQ ID NO: 122414 - DNA, 548 bp, Homo sapiens
  Payload ID: 3981
  Gene Symbol: CORO7
  Gene Name: coronin 7
  ENST ID: ENST00000572153
  CDS Start-End: 62-202
gtgcacctgagacccgacgcccggggtcctcgaagacgcgtccgccgccgtgcccgtcgccatgaaccgcttcagggtgtccaagttccggcacaccgaggctcggccgccccgccgcgaggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggtgagcaggcaggtggggat

SEQ ID NO: 122415 - DNA, 1737 bp, Homo sapiens
  Payload ID: 3981
  Gene Symbol: CORO7
  Gene Name: coronin 7
  ENST ID: ENST00000574311
  CDS Start-End: 79-1182
agtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagatgagggagaagaggcacagagaggtttagtgacctgcccgggtcacacagctgtctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacag

SEQ ID NO: 122416 - DNA, 2826 bp, Homo sapiens
  Payload ID: 3981
  Gene Symbol: CORO7
  Gene Name: coronin 7
  Uniprot ID: P57737
  ENST ID: ENST00000574025
  CDS Start-End: 110-2632
attgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctct

SEQ ID NO: 122417 - DNA, 832 bp, Homo sapiens
  Payload ID: 3981
  Gene Symbol: CORO7
  Gene Name: coronin 7
  ENST ID: ENST00000575038
  CDS Start-End: 229-832
ggtacaccgcaaagactccacagcaaatcctgcacacaaaatcgcgaatgctgcagccgagaccccacgcaagcaagcaccgcaggagacgtgggctgacagctgcgccccacgtgacctcccacccgcgccagtccgtcccctcgcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctgagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatggg

SEQ ID NO: 122418 - DNA, 3540 bp, Homo sapiens; identical to SEQ ID NO: 122397
  Payload ID: 3981
  Gene Symbol: CORO7
  Gene Name: coronin 7
  Uniprot ID: P57737
  ENST ID: ENST00000614702
  CDS Start-End: 147-2924

SEQ ID NO: 122419 - DNA, 3392 bp, Homo sapiens; identical to SEQ ID NO: 122398
  Payload ID: 3981
  Gene Symbol: CORO7
  Gene Name: coronin 7
  Uniprot ID: P57737
  ENST ID: ENST00000617235
  CDS Start-End: 112-2835

SEQ ID NO: 122420 - DNA, 581 bp, Homo sapiens; identical to SEQ ID NO: 122408
  Payload ID: 3981
  Gene Symbol: CORO7
  Gene Name: coronin 7
  ENST ID: ENST00000631678
  CDS Start-End: 112-581

SEQ ID NO: 122421 - DNA, 730 bp, Homo sapiens; identical to SEQ ID NO: 122409
  Payload ID: 3981
  Gene Symbol: CORO7
  Gene Name: coronin 7
  ENST ID: ENST00000631757
  CDS Start-End: 1-358

SEQ ID NO: 122422 - DNA, 1066 bp, Homo sapiens; identical to SEQ ID NO: 122404
  Payload ID: 3981
  Gene Symbol: CORO7
  Gene Name: coronin 7
  ENST ID: ENST00000632270
  CDS Start-End: 361-687

SEQ ID NO: 122423 - DNA, 666 bp, Homo sapiens; identical to SEQ ID NO: 122412
  Payload ID: 3981
  Gene Symbol: CORO7
  Gene Name: coronin 7
  ENST ID: ENST00000633804
  CDS Start-End: 47-666

SEQ ID NO: 122424 - DNA, 563 bp, Homo sapiens; identical to SEQ ID NO: 122399
  Payload ID: 3981
  Gene Symbol: CORO7
  Gene Name: coronin 7
  ENST ID: ENST00000633070
  CDS Start-End: 79-563

SEQ ID NO: 122425 - DNA, 3578 bp, Homo sapiens; identical to SEQ ID NO: 122400
  Payload ID: 3981
  Gene Symbol: CORO7
  Gene Name: coronin 7
  ENST ID: ENST00000632167
  CDS Start-End: 110-250

SEQ ID NO: 122426 - DNA, 540 bp, Homo sapiens; identical to SEQ ID NO: 122410
  Payload ID: 3981
  Gene Symbol: CORO7
  Gene Name: coronin 7
  ENST ID: ENST00000631960
  CDS Start-End: 78-422

SEQ ID NO: 122427 - DNA, 548 bp, Homo sapiens; identical to SEQ ID NO: 122414
  Payload ID: 3981
  Gene Symbol: CORO7
  Gene Name: coronin 7
  ENST ID: ENST00000633889
  CDS Start-End: 62-202

SEQ ID NO: 122428 - DNA, 1890 bp, Homo sapiens; identical to SEQ ID NO: 122401
  Payload ID: 3981
  Gene Symbol: CORO7
  Gene Name: coronin 7
  ENST ID: ENST00000633681
  CDS Start-End: 79-738

SEQ ID NO: 122429 - DNA, 501 bp, Homo sapiens; identical to SEQ ID NO: 122411
  Payload ID: 3981
  Gene Symbol: CORO7
  Gene Name: coronin 7
  ENST ID: ENST00000631578
  CDS Start-End: 361-501

SEQ ID NO: 122430 - DNA, 593 bp, Homo sapiens; identical to SEQ ID NO: 122402
  Payload ID: 3981
  Gene Symbol: CORO7
  Gene Name: coronin 7
  ENST ID: ENST00000632158
  CDS Start-End: 110-593

SEQ ID NO: 122431 - DNA, 832 bp, Homo sapiens; identical to SEQ ID NO: 122417
  Payload ID: 3981
  Gene Symbol: CORO7
  Gene Name: coronin 7
  ENST ID: ENST00000634048
  CDS Start-End: 229-832

SEQ ID NO: 122432 - DNA, 1737 bp, Homo sapiens; identical to SEQ ID NO: 122415
  Payload ID: 3981
  Gene Symbol: CORO7
  Gene Name: coronin 7
  ENST ID: ENST00000633467
  CDS Start-End: 79-1182

SEQ ID NO: 122433 - DNA, 557 bp, Homo sapiens; identical to SEQ ID NO: 122407
  Payload ID: 3981
  Gene Symbol: CORO7
  Gene Name: coronin 7
  ENST ID: ENST00000632177
  CDS Start-End: 525-557

SEQ ID NO: 122434 - DNA, 663 bp, Homo sapiens; identical to SEQ ID NO: 122405
  Payload ID: 3981
  Gene Symbol: CORO7
  Gene Name: coronin 7
  ENST ID: ENST00000632164
  CDS Start-End: 47-663

SEQ ID NO: 122435 - DNA, 578 bp, Homo sapiens; identical to SEQ ID NO: 122403
  Payload ID: 3981
  Gene Symbol: CORO7
  Gene Name: coronin 7
  ENST ID: ENST00000631809
  CDS Start-End: 407-578

SEQ ID NO: 122436 - DNA, 729 bp, Homo sapiens; identical to SEQ ID NO: 122406
  Payload ID: 3981
  Gene Symbol: CORO7
  Gene Name: coronin 7
  ENST ID: ENST00000632603
  CDS Start-End: 672-729

SEQ ID NO: 122437 - DNA, 605 bp, Homo sapiens; identical to SEQ ID NO: 122413
  Payload ID: 3981
  Gene Symbol: CORO7
  Gene Name: coronin 7
  ENST ID: ENST00000632515
  CDS Start-End: 1-573

SEQ ID NO: 122438 - DNA, 2826 bp, Homo sapiens; identical to SEQ ID NO: 122416
  Payload ID: 3981
  Gene Symbol: CORO7
  Gene Name: coronin 7
  Uniprot ID: P57737
  ENST ID: ENST00000631534
  CDS Start-End: 110-2632

SEQ ID NO: 122439 - DNA, 1803 bp, Homo sapiens
  Payload ID: 3982
  Gene Symbol: CORO1A
  Gene Name: coronin, actin binding protein, 1A
  Uniprot ID: P31146
  ENST ID: ENST00000219150
  CDS Start-End: 306-1691
agattcgcttcccggagccgggatggcagcctgcgctatggttggggaccaacgtggtgcacgggcaggggccggggagagaggcggccgcagcgggagcccgggagcgcagggcgggcctggaagagctccgccccaaggggcgcggccaccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 122440 - DNA, 582 bp, Homo sapiens
  Payload ID: 3982
  Gene Symbol: CORO1A
  Gene Name: coronin, actin binding protein, 1A
  ENST ID: ENST00000569203
  CDS Start-End: 139-582
accgcgacccagccagcgccggggccaggtagcgggcgcagcagcccgtggggggacgctgcttggagtgggggccgccggggccccagagcgctctgcggaggcgagggctagggaccaccgcggccaagatggagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctc

SEQ ID NO: 122441 - DNA, 1622 bp, Homo sapiens
  Payload ID: 3982
  Gene Symbol: CORO1A
  Gene Name: coronin, actin binding protein, 1A
  Uniprot ID: P31146
  ENST ID: ENST00000570045
  CDS Start-End: 237-1622
gtcttgacaagagcatcttcagcgggcgagtccccggctcctccagctccttcctcctcttcctcctcctcctccacctccggcttttgggggatcactgtcctctctcggcagcagatacaggctgctcctcaagactggggctcttcacatacgctcctcaccgctctttgggcaggccgacctagcagcctcttcgggagtcctggggtggccgggggtgctggagcccccaaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtag

SEQ ID NO: 122442 - DNA, 937 bp, Homo sapiens
  Payload ID: 3982
  Gene Symbol: CORO1A
  Gene Name: coronin, actin binding protein, 1A
  ENST ID: ENST00000563778
  CDS Start-End: 189-937
gttgctgcctccagaagcctctctgaatccaagggtgggaactattcctccttgccctcgagccttcgccaaagccagggcttggagcggccgtgggctcctcctccttcccccaggctgggctcttcaggggcggaaacctgcctggcttgcctgccttgctcgaccctgtagcccctggcacgaaaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtg

SEQ ID NO: 122443 - DNA, 1348 bp, Homo sapiens
  Payload ID: 3982
  Gene Symbol: CORO1A
  Gene Name: coronin, actin binding protein, 1A
  ENST ID: ENST00000565497
  CDS Start-End: 109-1278
gagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatg

SEQ ID NO: 122444 - DNA, 694 bp, Homo sapiens
  Payload ID: 3982
  Gene Symbol: CORO1A
  Gene Name: coronin, actin binding protein, 1A
  ENST ID: ENST00000561815
  CDS Start-End: 41-694
gctcgaccctgtagcccctggcacgaagtaggtgcccgtgatgccggattatttcagcaggagggcaggggtgttcccgatgaagccaggagatccagggaggagaagcgactcccggggccacccatgcttagatctcagagccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtg

SEQ ID NO: 122445 - DNA, 844 bp, Homo sapiens
  Payload ID: 3982
  Gene Symbol: CORO1A
  Gene Name: coronin, actin binding protein, 1A
  ENST ID: ENST00000570244
  CDS Start-End: 107-844
gcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaag

SEQ ID NO: 122446 - DNA, 714 bp, Homo sapiens
  Payload ID: 3982
  Gene Symbol: CORO1A
  Gene Name: coronin, actin binding protein, 1A
  ENST ID: ENST00000569970
  CDS Start-End: 219-714
ccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgaggaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcgg

SEQ ID NO: 122447 - DNA, 1881 bp, Homo sapiens
  Payload ID: 3983
  Gene Symbol: CORO1B
  Gene Name: coronin, actin binding protein, 1B
  Uniprot ID: Q9BR76
  ENST ID: ENST00000341356
  CDS Start-End: 112-1581
ctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcat

SEQ ID NO: 122448 - DNA, 1931 bp, Homo sapiens
  Payload ID: 3983
  Gene Symbol: CORO1B
  Gene Name: coronin, actin binding protein, 1B
  Uniprot ID: Q9BR76
  ENST ID: ENST00000393893
  CDS Start-End: 134-1603
acccaatcctggagactcctgcggatgccattatgaggagcaagaacgcgaaggggcctcgggtccgctaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaagcc

SEQ ID NO: 122449 - DNA, 551 bp, Homo sapiens
  Payload ID: 3983
  Gene Symbol: CORO1B
  Gene Name: coronin, actin binding protein, 1B
  ENST ID: ENST00000545016
  CDS Start-End: 134-551
acccaatcctggagactcctgcggatgccattatgaggagcaagaacgcgaaggggcctcgggtccgctaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcct

SEQ ID NO: 122450 - DNA, 1954 bp, Homo sapiens
  Payload ID: 3983
  Gene Symbol: CORO1B
  Gene Name: coronin, actin binding protein, 1B
  ENST ID: ENST00000537042
  CDS Start-End: 56-904
tccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccaggctccccgctcctccagaaagcctcctcctccagcaagcctcctggccccagccctctctgcttctgcatagtgacctccagggcaccttgagcaggggctggtgccgctggcaccccagctccccacagtgaggaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatat

SEQ ID NO: 122451 - DNA, 4464 bp, Homo sapiens
  Payload ID: 3983
  Gene Symbol: CORO1B
  Gene Name: coronin, actin binding protein, 1B
  ENST ID: ENST00000616321
  CDS Start-End: 84-866
cctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccaggggtgaggaggttctgcttggcctgactgcctgcaatgtgccaggaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaagccaggctgacctgctgctgcaagggtggggctgagaagtctggaaacctggagacagaggatgtcacaggagtcacacatgtgcagaaggtctgggggcagtgagcagccccacaggcattgctcccctggattgtcaggcagggaaactgaggcagaagacctgagaacacatgcaaggctgcatccagcttcaagttggtgctgcttcttccttggaggacaggcccggcagcccagcctcctccagagagactggggagggtctggtgtggaccaggggtcctgcagcagggaggggcaggtggggtatgtgggcaggaagcggaagcctgggccacccttcactgcagacgagcactgagctcacttctcgctcgacacagccagagctggaggtgggtgcccggcacggaggggcctgcggaccaatggtaagcctcggagccccccgggttcttgggatgggggccacaggcggtcggggctagaatgtctgggcctgtggagctaaggagggccccacattggccccagggaagaggtgagacctaagaggagtatggcagaggctgaacctttctctcacctgagctgggctccctgggactccaggcctggcccccagcaccccataccggaccaggcccctgtcaggagccctgggaaggcccttacctggtcttcctgtgagcgggaacttgcattcctggagcctgggcggacagcctggggtggtgggggaggctggctgcacctcagcacccctcccccgacaccccccacctagcctgttccgaccgcagacttcctctggcagctgcgcccgcctcccccagccccccccagcccccggccctgcacgcctgtggccctcagggactgggagtggaacggaaaccctgccgctggggcagccccgtggtggggagggaggaagaggggcctcacggacccccgtttggggacctggccaagcagaagatgagcagttgcctctgggtgcatccaggcccctccatcccccatcccaggcctcagggagagccagccctgacaccagctagcaacctccttccctccctcccatctcctctcccacccacccaggcagcctagacacatttaatccatacttattgagcacctactaacatgcttgacccaaaaagcccccgtttcctagcagcttattgtggggggtagataagacaatagacataaaaaatgagtacagttatctcctgcgttaggtgacatggaaggaaaaaggcactgagtgctggggggtgctggggtgggctgcagtgatagacatcagggtagaggttaaggtcaggttcagcctcactggggtgaagtttgagcacggtgagcaggccatgcagcccgggggaggggaggatgggaggaggtggagctttccgggcagagggaacagccagtgcgaaggccccaggcaggtggcttaatgcagctgttgggggaggtgagtggtagggaggaggctggagggatgggggctgatctcacagggccagagcctggttgaccaaataaggccttggccttttctgcttggctgtcccaagaggatcccaaagagaaaaaaacgaaagtggtcttggtcacccagcctgccccacaccaggccccaccccaggtgctgagccctctgagcccctgcctgtctcccacaggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtg

SEQ ID NO: 122452 - DNA, 960 bp, Homo sapiens
  Payload ID: 3983
  Gene Symbol: CORO1B
  Gene Name: coronin, actin binding protein, 1B
  ENST ID: ENST00000627576
  CDS Start-End: 112-960
ctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccaggctccccgctcctccagaaagcctcctcctccagcaagcctcctggccccagccctctctgcttctgcatagtgacctccagggcaccttga

SEQ ID NO: 122453 - DNA, 3892 bp, Homo sapiens
  Payload ID: 3984
  Gene Symbol: CORO1C
  Gene Name: coronin, actin binding protein, 1C
  Uniprot ID: Q9ULV4
  ENST ID: ENST00000261401
  CDS Start-End: 174-1598
gcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 122454 - DNA, 3921 bp, Homo sapiens
  Payload ID: 3984
  Gene Symbol: CORO1C
  Gene Name: coronin, actin binding protein, 1C
  Uniprot ID: Q9ULV4
  ENST ID: ENST00000420959
  CDS Start-End: 50-1633
aggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaaggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgatt

SEQ ID NO: 122455 - DNA, 1296 bp, Homo sapiens
  Payload ID: 3984
  Gene Symbol: CORO1C
  Gene Name: coronin, actin binding protein, 1C
  ENST ID: ENST00000421578
  CDS Start-End: 164-1273
acacttcatatcacaacaagcctgtaaatcctgccttaaacaaactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacag

SEQ ID NO: 122456 - DNA, 2487 bp, Homo sapiens
  Payload ID: 3984
  Gene Symbol: CORO1C
  Gene Name: coronin, actin binding protein, 1C
  Uniprot ID: Q9ULV4
  ENST ID: ENST00000541050
  CDS Start-End: 227-1651
gcgagaccagctctgggccctgcagatctcggttgggggtcaggcggggcggggcagagctggagctggagtaatgtgggtgggggcggcttgggaagaggctgagcccggccaagggagcagagggctgggactggctgggggttgggaggggaggaacgaagcaggaaggctgtcggatcgggggcccagggtgtccgagtgaactgggtgattcagagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaact

SEQ ID NO: 122457 - DNA, 567 bp, Homo sapiens
  Payload ID: 3984
  Gene Symbol: CORO1C
  Gene Name: coronin, actin binding protein, 1C
  ENST ID: ENST00000551044
  CDS Start-End: 114-567
gtcggatcgggggcccagggtgtccgagtgaactgggtgattcagaggtgtgtttccctaatagcggggcagctggcgagggacgcagtaaaaaggagcgaggtgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggtggga

SEQ ID NO: 122458 - DNA, 577 bp, Homo sapiens
  Payload ID: 3984
  Gene Symbol: CORO1C
  Gene Name: coronin, actin binding protein, 1C
  ENST ID: ENST00000546705
  CDS Start-End: 1-498
agcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaagaaattgggtgtttgtaccagaatggaattttgcttctcggttatcctgtgcttcagatgattataatctaacccaaa

SEQ ID NO: 122459 - DNA, 1710 bp, Homo sapiens
  Payload ID: 3984
  Gene Symbol: CORO1C
  Gene Name: coronin, actin binding protein, 1C
  Uniprot ID: Q9ULV4
  ENST ID: ENST00000549772
  CDS Start-End: 268-1710
ttttgcttttcaccacctcatggaagctgtcttatctaactcacgcttgagaagtattcatattgattccaaaatgaaggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaaggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctga

SEQ ID NO: 122460 - DNA, 547 bp, Homo sapiens
  Payload ID: 3984
  Gene Symbol: CORO1C
  Gene Name: coronin, actin binding protein, 1C
  ENST ID: ENST00000550032
  CDS Start-End: 39-547
aattctaacataattctcactcttcctttgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttgga

SEQ ID NO: 122461 - DNA, 1245 bp, Homo sapiens
  Payload ID: 3984
  Gene Symbol: CORO1C
  Gene Name: coronin, actin binding protein, 1C
  ENST ID: ENST00000550542
  CDS Start-End: 104-583
cggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcagaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccct

SEQ ID NO: 122462 - DNA, 899 bp, Homo sapiens
  Payload ID: 3984
  Gene Symbol: CORO1C
  Gene Name: coronin, actin binding protein, 1C
  ENST ID: ENST00000546571
  CDS Start-End: 413-899
gctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatgacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacag

SEQ ID NO: 122463 - DNA, 547 bp, Homo sapiens
  Payload ID: 3984
  Gene Symbol: CORO1C
  Gene Name: coronin, actin binding protein, 1C
  ENST ID: ENST00000551550
  CDS Start-End: 58-547
aggctttcgaggtccggaacgctcctggccgggtgcggagccgcgggccgagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacagggg

SEQ ID NO: 122464 - DNA, 566 bp, Homo sapiens
  Payload ID: 3984
  Gene Symbol: CORO1C
  Gene Name: coronin, actin binding protein, 1C
  ENST ID: ENST00000547294
  CDS Start-End: 22-566
actaggcggtttggtaacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctg

SEQ ID NO: 122465 - DNA, 587 bp, Homo sapiens
  Payload ID: 3984
  Gene Symbol: CORO1C
  Gene Name: coronin, actin binding protein, 1C
  ENST ID: ENST00000552871
  CDS Start-End: 211-587
agtgccaggctggaggcggcagcggttggaggcttcgcccggctttgcagcggggacttcggcggcggcgcctcaggcacctcggcccggactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaa

SEQ ID NO: 122466 - DNA, 5635 bp, Homo sapiens
  Payload ID: 3985
  Gene Symbol: CORO2A
  Gene Name: coronin, actin binding protein, 2A
  Uniprot ID: Q92828
  ENST ID: ENST00000343933
  CDS Start-End: 259-1836
cactgacatctttgctggactcttttaatcctcataaacccaggctgctggcacttgaaatttgagaagggcaatcagtctggcctcctgcctttctggcctgcaggcccagcctggacaaacaatttaggtggagctcctggaggctggaagcagagaggaggtacctcaccatcctctcctgccagctgttgcagactctgcctggggaactgattaagggtgagcagaggcatttatctccatgttaacaagcagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccagctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactacaa

SEQ ID NO: 122467 - DNA, 5459 bp, Homo sapiens
  Payload ID: 3985
  Gene Symbol: CORO2A
  Gene Name: coronin, actin binding protein, 2A
  Uniprot ID: Q92828
  ENST ID: ENST00000375077
  CDS Start-End: 83-1660
cgggagtcggcgggcggcgaggagcgcggagccggagctggacgccgccgccgccaccgccacctgcgcggcagtcatcaagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccagctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactacaa

SEQ ID NO: 122468 - DNA, 3569 bp, Homo sapiens
  Payload ID: 3986
  Gene Symbol: CORO2B
  Gene Name: coronin, actin binding protein, 2B
  Uniprot ID: Q9UQ03
  ENST ID: ENST00000261861
  CDS Start-End: 310-1737
cgggccctctccctctctccctttcttcctgcctcgccttcctgcggcgaaggaggctcatctattataaatgcacattcggggctgacatcagcgacgagcggcgggcgagcgccgacgagcggtccctgcgcgctgcccgcccggagcgcagcccccaggctcggccgagccgccggcggggcgcggggagcgagccgggagctgccggacccccttccgccgccgccccgggccgccgccgccgcccccgcacgccgcgcccgcgcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaa

SEQ ID NO: 122469 - DNA, 3611 bp, Homo sapiens
  Payload ID: 3986
  Gene Symbol: CORO2B
  Gene Name: coronin, actin binding protein, 2B
  Uniprot ID: Q9UQ03
  ENST ID: ENST00000543950
  CDS Start-End: 355-1782
acagattctgttgacctttagtaatgagggaggcagggctagagggtgactagcagccaggcctcccaggctcccaggcctctcagatgcctggaatttcggagctagaaggtagtcagattcccgttatcttgactgctgcagcggggtctctgggatggtgatgtgagtgcctcctgcacccgtggcccccatgtggcataactccttgggcgctattcatccacacggcccatctgtgcagggtacagccttcatggtcttagctggcagccctgacaacttggatgtgcaaagaagatacaagtttgtttcctctgaagcttgtctggtgtcatccaggagccccacctgatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 122470 - DNA, 3332 bp, Homo sapiens
  Payload ID: 3986
  Gene Symbol: CORO2B
  Gene Name: coronin, actin binding protein, 2B
  Uniprot ID: Q9UQ03
  ENST ID: ENST00000540068
  CDS Start-End: 76-1503
attcaaaccgcctgctgggtgccgtgggccattgtgcaagtcttccaggccgcggtcgaatgattctgacaagcgatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 122471 - DNA, 3566 bp, Homo sapiens
  Payload ID: 3986
  Gene Symbol: CORO2B
  Gene Name: coronin, actin binding protein, 2B
  Uniprot ID: Q9UQ03
  ENST ID: ENST00000566799
  CDS Start-End: 295-1737
cgggccctctccctctctccctttcttcctgcctcgccttcctgcggcgaaggaggctcatctattataaatgcacattcggggctgacatcagcgacgagcggcgggcgagcgccgacgagcggtccctgcgcgctgcccgcccggagcgcagcccccaggctcggccgagccgccggcggggcgcggggagcgagccgggagctgccggacccccttccgccgccgccccgggccgccgccgccgcccccgcacgccgcgcccgcgcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 122472 - DNA, 3272 bp, Homo sapiens
  Payload ID: 3987
  Gene Symbol: CTTN
  Gene Name: cortactin
  Uniprot ID: Q14247
  ENST ID: ENST00000301843
  CDS Start-End: 207-1859
gatgcggccccgcccccgccctcggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 122473 - DNA, 3272 bp, Homo sapiens
  Payload ID: 3987
  Gene Symbol: CTTN
  Gene Name: cortactin
  Uniprot ID: Q14247
  ENST ID: ENST00000346329
  CDS Start-End: 309-1850
ggccgggctagcgcttagccagctgcgggcggacccccgggactcttgcgggccaagacgcgggaggaggcggggcagggggcggggtcgcgcggggacccggatgcggccccgcccccgccctcggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttgcgtga

SEQ ID NO: 122474 - DNA, 2247 bp, Homo sapiens
  Payload ID: 3987
  Gene Symbol: CTTN
  Gene Name: cortactin
  Uniprot ID: Q14247
  ENST ID: ENST00000376561
  CDS Start-End: 172-2076
agagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccgcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttg

SEQ ID NO: 122475 - DNA, 952 bp, Homo sapiens
  Payload ID: 3987
  Gene Symbol: CTTN
  Gene Name: cortactin
  ENST ID: ENST00000529736
  CDS Start-End: 1-798
accagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccgcttcagggagctcgcattctcttgtgttcgtgttgccctcgtgcccatcaagtgcagtcgggacctcccaggacaagcacgaggcctcaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaac

SEQ ID NO: 122476 - DNA, 567 bp, Homo sapiens
  Payload ID: 3987
  Gene Symbol: CTTN
  Gene Name: cortactin
  ENST ID: ENST00000533931
  CDS Start-End: 1-387
cggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagctctgtcatggctttcttttagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagct

SEQ ID NO: 122477 - DNA, 5970 bp, Homo sapiens
  Payload ID: 3988
  Gene Symbol: CTTNBP2
  Gene Name: cortactin binding protein 2
  Uniprot ID: Q8WZ74
  ENST ID: ENST00000160373
  CDS Start-End: 93-5084
ggacagcagcgggttaagtgccgcccgcgcggagacggctgagtccggagccgcggctccgagctcgcattcggatccgctagagcaggaagatggcgacggacggcgcgagctgcgagcccgacttgtcccgggccccggaggacgcggcgggggccgcggcggaggcggcgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccgttttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaaa

SEQ ID NO: 122478 - DNA, 760 bp, Homo sapiens
  Payload ID: 3988
  Gene Symbol: CTTNBP2
  Gene Name: cortactin binding protein 2
  ENST ID: ENST00000445366
  CDS Start-End: 1-142
gtccgtctggcgtcagcttaactcctgcctggcccgcttgggcacacctgaagcacttcttggaccaaaatatttcctgtcttgtcctgtagttcctgggcatgcccaagtgacagtgaaagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcag

SEQ ID NO: 122479 - DNA, 4250 bp, Homo sapiens
  Payload ID: 3988
  Gene Symbol: CTTNBP2
  Gene Name: cortactin binding protein 2
  ENST ID: ENST00000446636
  CDS Start-End: 1-3454
agatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcagaaaatacaaaaggtaaaatgtaccagagaggagccttcttgctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccgttttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttct

SEQ ID NO: 122480 - DNA, 470 bp, Homo sapiens
  Payload ID: 3988
  Gene Symbol: CTTNBP2
  Gene Name: cortactin binding protein 2
  ENST ID: ENST00000412853
  CDS Start-End: 185-470
aaaaggagattgtatagaaagttaggagctgaggggctggtgccacgttctaaaagaaaacaggacagacaaatcgttttcatctgagaattgtttttggagaaacactagagtcaacgatagaataaatcagagccagaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaaga

SEQ ID NO: 122481 - DNA, 580 bp, Homo sapiens
  Payload ID: 3988
  Gene Symbol: CTTNBP2
  Gene Name: cortactin binding protein 2
  ENST ID: ENST00000435233
  CDS Start-End: 1-580
atgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctgcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttatt

SEQ ID NO: 122482 - DNA, 578 bp, Homo sapiens
  Payload ID: 3988
  Gene Symbol: CTTNBP2
  Gene Name: cortactin binding protein 2
  ENST ID: ENST00000434890
  CDS Start-End: 95-578
agatcgtaaacaaaacccaggacgccaggcagatttctgtgttaacaagaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaaga

SEQ ID NO: 122483 - DNA, 5517 bp, Homo sapiens
  Payload ID: 3988
  Gene Symbol: CTTNBP2
  Gene Name: cortactin binding protein 2
  ENST ID: ENST00000441556
  CDS Start-End: 15-1937
gctagagcaggaagatggcgacggacggcgcgagctgcgagcccgacttgtcccgggccccggaggacgcggcgggggccgcggcggaggcggcgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccgttttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaa

SEQ ID NO: 122484 - DNA, 570 bp, Homo sapiens
  Payload ID: 3988
  Gene Symbol: CTTNBP2
  Gene Name: cortactin binding protein 2
  ENST ID: ENST00000454375
  CDS Start-End: 163-570
gctttctggagagggagaggagagatgtggaggaaggtacttggggtgagaggagctgagcctggcaatggaaggagaaacggggaggaggactgctaatttccacttgtaaaactgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgc

SEQ ID NO: 122485 - DNA, 530 bp, Homo sapiens
  Payload ID: 3988
  Gene Symbol: CTTNBP2
  Gene Name: cortactin binding protein 2
  ENST ID: ENST00000416239
  CDS Start-End: 1-362
catgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctgatggggaaactgaacagagagaggtaaaatgctcaaagtcatgcatctagcaagtgatgaagccaggattgtgcaagtctctgatgtgtatgagatcaatctgaaactaatactactggtataaaacattaaacataattttgcttgctgccttaatttcgatgacctttttaaataaatgagttggaactatga

SEQ ID NO: 122486 - DNA, 1274 bp, Homo sapiens
  Payload ID: 3989
  Gene Symbol: CTXN1
  Gene Name: cortexin 1
  Uniprot ID: P60606
  ENST ID: ENST00000318978
  CDS Start-End: 221-469
ataggaacagccgcggcggcccggctcgcgcgctgcttgcctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcggggccaggactgcgctcaggatcccgccccggagcccccagcccgggggagagggggagggagttgggagaagcccagcccctccccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaa

SEQ ID NO: 122487 - DNA, 2828 bp, Homo sapiens
  Payload ID: 3990
  Gene Symbol: CTXN2
  Gene Name: cortexin 2
  Uniprot ID: P0C2S0
  ENST ID: ENST00000417307
  CDS Start-End: 373-618
acacagatgctgccacagacacacgcgagcgcaaatatttacacactgccacaccgaagaaatccatgcacgttttcctgcaaacgcgcgcgcgcacacgtacttcggcgggcgcccacgtcctctgtctcaccaacagacacagacatttacacttctaggccaggaaagcgctaaccagggccctgtgactctacgcaggttccagaacacgccttctacatttgttactgaaccgatcagcgaacacagacaaacgtgccaacacttaagtctactggctggacttcatctccatggcaacaagcatggaaggcaaagagttgattccagaaggaactgtgaagagccacaacaatgtgccagtgaataatgagtagtacctactgtggcaactcttcagctaagatgagtgtcaacgaagtatcagctttctcattgactctggagcaaaaaactggctttgcttttgttgggattttgtgtatcttcttgggacttcttattatccgatgcttcaaaatcctgctagacccatatagtagcatgccttcctctacatgggaagatgaagttgaagagtttgataaagggacatttgaatatgcactcgcgtgagagttccagctatatggtttttatggttgtgccatcgggacacattctggatacaattgtaactaccttgagggtgtgggagagaggctcattttgttcagtgaattcaataaacatctgtgactaatttcttcaccatgctgtgtaaatgataaactattgttgggattcctcactttcctctgttcccacttagaggtttccaatgaatagagcataaggatggctgccgccatgtttaccatctttattcttatcttgaacaactgccttgaatttctgcttcctttcttgtgctaataaactgtgccaaaggcatcttgctctctcccctctgaaaagcccaggcatcccctccacattcctgactcagacccctttagctttagtgagtcaggtcttaaacagagaatttagtccaaagaataatcaaaatattatttgtctaataataaccataggcccaaaaggttcacaggtgaaaaaatatctcaaaaatctaacacccaaagcctacaagtagtcacaggccctaaagctccccaaatttcacagagccctgaccctcctatctcttctgtttgtcgaatctcttgcagtaaaatcccatagcttggaatccaaaccagatctgcctcatactgatgctccctcccctaccccttgcataaatagaatttaaaagggagtttccagcatgacctagtggaaagagtactctaagcagaaacaaagacagtctcagctgtgccaccagtagagctatgctctaatgggtaagtcatctaatctctgtgagcttcagtgaagagtagtgttaacatccttttcaattctagtgccctatgaatgctacaaatgtatctgaaaacccagagatctgaaatgaatgaggatttaagatatcatgaaaagtttttcagattaggagcctaaactcagagatttgaattctaatgttagcttagccaagaactagctttatgacctagaaagttacctaaagggaacctatattgcacaacaagaattaagaaacccatcctgcatgtcttcagcaatattgagagggccaattagatataatgaatgtgaaagcattttgtaaaccataaaacagtatctaaacataccttgctatcaatatttattgtcctcatcagtagcagtaatagagattctcaaaccctaagaagcaatggcttagtgtaaattattcaatctctctagtatttcattctcttcaattgagaaataaaaagataaaattatatagttctaaattctttccaactacaaacttctgactctctatgagtcagaatggaggaacatagcaggagataaatacaaaaatatttatgtcctttgaaaacacagaactgcaaaacataccatgaaggaacaagactaatattaccaagaggtagcactaagttagttactttcaatttatttgatactcttataaattctttgagttggagactactatttccattttatttttaatcttaattttgcagaagagaaactgaagctaagagaaattaactagcttcccaaggtcaccatagctagggaatggttatgttagggattgaacttgggcagtttgatttctgctgtatccctagacactgtcctcaacacttctacatagcttataggcatggttactgctcaggtctatggaattccaaaaccagctgtctctgtgagattccttgatgctttccatctcataatagatttagaacatatctgttattagctatggatcttctggaccaaatcctcacctcaaggaggctctctgtaccccagttggttcaagagtgtaggcctggtacacctcatagccagttagtaacttggcccaagaacaggccactgggccaagttcaactgaacatactgaaaattgtgtgtgccaggaaactaggtctctttgttgaccaaggcttttaaagtaccagatgtttcatttgtctcccagagaagacacccaccaagaccctccattttgatgactagaacaaaccaaggccagatctttatttcaaaggaagaaagacctctacaaccaagaaaactttatgaaatatgagcattgtttctggaagttcaactcccataagcttttcaagtatattaactctaccataatattatttccaaatccactaaagaaaaattctattaaccaa

SEQ ID NO: 122488 - DNA, 1660 bp, Homo sapiens
  Payload ID: 3991
  Gene Symbol: CTXN3
  Gene Name: cortexin 3
  Uniprot ID: Q4LDR2
  ENST ID: ENST00000379445
  CDS Start-End: 552-797
agacacactgctaggatactgcctctactcgctgaagcagaatcctctgaagagttgctgaggcagaactgaaatcatggctcacctcaaagaagcagcagtattggccgttaatgatgcctcacacagaaagacgatgctcctttaactcggggttttaatgggaagtttctaagcctgaaacaacagctttagacctggggtgtgccatcagctgccttgcagctaccactgtctactgctttcacacagcgtggtcgggaagaatggaaactaaagaggcttgtaactacctgtaactgttccaccaggaaatggatcaagtgtttgttcagccagagccagtattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 122489 - DNA, 1458 bp, Homo sapiens
  Payload ID: 3991
  Gene Symbol: CTXN3
  Gene Name: cortexin 3
  Uniprot ID: Q4LDR2
  ENST ID: ENST00000395322
  CDS Start-End: 350-595
ggcttaaaaagatgaatcgagatgcagtgtgtaggaagcatgggcaagggatgaggaacgccactttgaaaattactaaaactaaagcaagtgactaagagtgtgaatgaccctggctgcaatgactacgcctgctgggcttctattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 122490 - DNA, 1208 bp, Homo sapiens
  Payload ID: 3991
  Gene Symbol: CTXN3
  Gene Name: cortexin 3
  Uniprot ID: Q4LDR2
  ENST ID: ENST00000620385
  CDS Start-End: 100-345
ataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 122491 - DNA, 1543 bp, Homo sapiens
  Payload ID: 3992
  Gene Symbol: CRH
  Gene Name: corticotropin releasing hormone
  Uniprot ID: P06850
  ENST ID: ENST00000276571
  CDS Start-End: 448-1038
aagtcataagaagcccttccattttagggctcgttgacgtcaccaagaggcgataaatatctgttgatataattggatgtgagattcagtgttgagatagcaaaattctgcccctcgttccttggcagggccctatgatttatgcaggagcagaggcagcacgcaatcgagctgtcaagagagcgtcagcttattaggcaaatgctgcgtggtttttgaagagggtcgacactataaaatcccactccaggctctggagtggagaaactcagagaccaagtccattgagagactgaggggaaagagaggagagaaagaaaaagagagtgggaacagtaaagagaaaggaagacaacctccagagaaagcccccggagacgtctctctgcagagaggcggcagcacccggctcacctgcgaagcgcctgggaagcgagtgcccctaacatgcggctgccgctgcttgtgtccgcgggagtcctgctggtggctctcctgccctgcccgccatgcagggcgctcctgagccgcgggccggtcccgggagctcggcaggcgccgcagcaccctcagcccttggatttcttccagccgccgccgcagtccgagcagccccagcagccgcaggctcggccggtcctgctccgcatgggagaggagtacttcctccgcctggggaacctcaacaagagcccggccgctcccctttcgcccgcctcctcgctcctcgccggaggcagcggcagccgcccttcgccggaacaggcgaccgccaactttttccgcgtgttgctgcagcagctgctgctgcctcggcgctcgctcgacagccccgcggctctcgcggagcgcggcgctaggaatgccctcggcggccaccaggaggcaccggagagagaaaggcggtccgaggagcctcccatctccctggatctcaccttccacctcctccgggaagtcttggaaatggccagggccgagcagttagcacagcaagctcacagcaacaggaaactcatggagattattgggaaataaaacggtgcgtttggccaaaaagaatctgcatttagcacaaaaaaaatttaaaaaaatacagtattctgtaccatagcgctgctcttatgccatttgtttatttttatatagcttgaaacatagagggagagagggagagagcctataccccttacttagcatgcacaaagtgtattcacgtgcagcagcaacacaatgttattcgttttgtctacgtttagtttccgtttccaggtgtttatagtggtgttttaaagagaatgtagacctgtgagaaaacgttttgtttgaaaaagcagacagaagtcactcaattgtttttgttgtggtctgagccaaagagaatgccattctcttgggtgggtaagactaaatctgtaagctctttgaaacaactttctcttgtaaacgtttcagtaataaaacatctttccagtccttggtcagtttggttgtgtaagagaatgttgaatacttatatttttaataaaagttgcaaaggtaa

SEQ ID NO: 122492 - DNA, 1980 bp, Homo sapiens
  Payload ID: 3993
  Gene Symbol: CRHBP
  Gene Name: corticotropin releasing hormone binding protein
  Uniprot ID: P24387
  ENST ID: ENST00000274368
  CDS Start-End: 423-1391
actttgatttgcaaaatggaaaattccctgaatgcccacagaaaagtataatgtagcatttagcaggtcaacaaaatgcactcccttattctttgtctccgcctcattctccaacactttagtgcactaagttgtagtgactgaaatcattcttggtgaataatgctgggccacgctgaaaatttgtggctgagagctggaccctcgtcatcgccacgtactctgtcaatgagacagggtaacccatggttactgagctccgatcagttaaggggcagagagcctccgctccccactgctctataaaagagacccagcaaagggaccctaccagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggcaccatga

SEQ ID NO: 122493 - DNA, 912 bp, Homo sapiens
  Payload ID: 3993
  Gene Symbol: CRHBP
  Gene Name: corticotropin releasing hormone binding protein
  ENST ID: ENST00000506501
  CDS Start-End: 87-803
tctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaaggtgagttgcttacttgtttcctaaccgtttgataaggccacaactttatcagagcagaagcaatcatatagggaaaacctggacactagcaaattggcgtagtacgttgctctgatgaactcttaaatctcaa

SEQ ID NO: 122494 - DNA, 2462 bp, Homo sapiens
  Payload ID: 3994
  Gene Symbol: CRHR1
  Gene Name: corticotropin releasing hormone receptor 1
  ENST ID: ENST00000347197
  CDS Start-End: 239-676
gccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaacca

SEQ ID NO: 122495 - DNA, 2621 bp, Homo sapiens
  Payload ID: 3994
  Gene Symbol: CRHR1
  Gene Name: corticotropin releasing hormone receptor 1
  ENST ID: ENST00000293493
  CDS Start-End: 266-1558
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122496 - DNA, 2535 bp, Homo sapiens
  Payload ID: 3994
  Gene Symbol: CRHR1
  Gene Name: corticotropin releasing hormone receptor 1
  Uniprot ID: P34998
  ENST ID: ENST00000314537
  CDS Start-End: 226-1473
gggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccag

SEQ ID NO: 122497 - DNA, 2490 bp, Homo sapiens
  Payload ID: 3994
  Gene Symbol: CRHR1
  Gene Name: corticotropin releasing hormone receptor 1
  ENST ID: ENST00000339069
  CDS Start-End: 483-1427
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122498 - DNA, 1146 bp, Homo sapiens
  Payload ID: 3994
  Gene Symbol: CRHR1
  Gene Name: corticotropin releasing hormone receptor 1
  Uniprot ID: P34998
  ENST ID: ENST00000352855
  CDS Start-End: 19-1146
agccgagcgagcccgaggatgggagggcacccgcagctccgtctcgtcaaggcccttctccttctggggctgaaccccgtctctgcctccctccaggaccagcactgcgagagcctgtccctggccagcaacatctcagacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctga

SEQ ID NO: 122499 - DNA, 2399 bp, Homo sapiens
  Payload ID: 3994
  Gene Symbol: CRHR1
  Gene Name: corticotropin releasing hormone receptor 1
  Uniprot ID: P34998
  ENST ID: ENST00000398285
  CDS Start-End: 1-1335
atgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagca

SEQ ID NO: 122500 - DNA, 1272 bp, Homo sapiens
  Payload ID: 3994
  Gene Symbol: CRHR1
  Gene Name: corticotropin releasing hormone receptor 1
  ENST ID: ENST00000535778
  CDS Start-End: 1-157
gtgctggtttggcaaaaggcctggggtgtacaccgactacatctaccagggccccatgatcctggtcctgctggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgccc

SEQ ID NO: 122501 - DNA, 1206 bp, Homo sapiens
  Payload ID: 3994
  Gene Symbol: CRHR1
  Gene Name: corticotropin releasing hormone receptor 1
  Uniprot ID: P34998
  ENST ID: ENST00000577353
  CDS Start-End: 1-1206
atgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctga

SEQ ID NO: 122502 - DNA, 777 bp, Homo sapiens
  Payload ID: 3994
  Gene Symbol: CRHR1
  Gene Name: corticotropin releasing hormone receptor 1
  ENST ID: ENST00000583888
  CDS Start-End: 1-459
tatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctg

SEQ ID NO: 122503 - DNA, 223 bp, Homo sapiens
  Payload ID: 3994
  Gene Symbol: CRHR1
  Gene Name: corticotropin releasing hormone receptor 1
  ENST ID: ENST00000580876
  CDS Start-End: 1-223
gtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacagggcttctttgtgtctgtgttctactgtttcctcaatagtgaggtccgttctgccatccggaaga

SEQ ID NO: 122504 - DNA, 479 bp, Homo sapiens
  Payload ID: 3994
  Gene Symbol: CRHR1
  Gene Name: corticotropin releasing hormone receptor 1
  ENST ID: ENST00000580955
  CDS Start-End: 1-281
tgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggaggagcctgggcctcaggcacagcctgggagagcacaccgtggtgggacatgaaacggattctgggggtctggtttgtggaccaaggttcactgctcaccgtgtggggagagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccact

SEQ ID NO: 122505 - DNA, 2577 bp, Homo sapiens
  Payload ID: 3994
  Gene Symbol: CRHR1
  Gene Name: corticotropin releasing hormone receptor 1
  Uniprot ID: P34998
  ENST ID: ENST00000618382
  CDS Start-End: 266-1513
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122506 - DNA, 1146 bp, Homo sapiens; identical to SEQ ID NO: 122498
  Payload ID: 3994
  Gene Symbol: CRHR1
  Gene Name: corticotropin releasing hormone receptor 1
  Uniprot ID: P34998
  ENST ID: ENST00000616748
  CDS Start-End: 19-1146

SEQ ID NO: 122507 - DNA, 2370 bp, Homo sapiens
  Payload ID: 3994
  Gene Symbol: CRHR1
  Gene Name: corticotropin releasing hormone receptor 1
  ENST ID: ENST00000618144
  CDS Start-End: 266-730
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggttcctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122508 - DNA, 2371 bp, Homo sapiens
  Payload ID: 3994
  Gene Symbol: CRHR1
  Gene Name: corticotropin releasing hormone receptor 1
  ENST ID: ENST00000617446
  CDS Start-End: 266-826
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122509 - DNA, 2622 bp, Homo sapiens
  Payload ID: 3994
  Gene Symbol: CRHR1
  Gene Name: corticotropin releasing hormone receptor 1
  ENST ID: ENST00000614143
  CDS Start-End: 266-1558
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122510 - DNA, 2621 bp, Homo sapiens
  Payload ID: 3994
  Gene Symbol: CRHR1
  Gene Name: corticotropin releasing hormone receptor 1
  ENST ID: ENST00000616225
  CDS Start-End: 266-1558
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggttcctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122511 - DNA, 2399 bp, Homo sapiens; identical to SEQ ID NO: 122499
  Payload ID: 3994
  Gene Symbol: CRHR1
  Gene Name: corticotropin releasing hormone receptor 1
  Uniprot ID: P34998
  ENST ID: ENST00000616274
  CDS Start-End: 1-1335

SEQ ID NO: 122512 - DNA, 2457 bp, Homo sapiens
  Payload ID: 3994
  Gene Symbol: CRHR1
  Gene Name: corticotropin releasing hormone receptor 1
  Uniprot ID: P34998
  ENST ID: ENST00000615345
  CDS Start-End: 266-1393
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcagacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122513 - DNA, 2490 bp, Homo sapiens
  Payload ID: 3994
  Gene Symbol: CRHR1
  Gene Name: corticotropin releasing hormone receptor 1
  ENST ID: ENST00000621969
  CDS Start-End: 483-1427
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggttcctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122514 - DNA, 2535 bp, Homo sapiens
  Payload ID: 3994
  Gene Symbol: CRHR1
  Gene Name: corticotropin releasing hormone receptor 1
  Uniprot ID: P34998
  ENST ID: ENST00000617905
  CDS Start-End: 226-1473
gggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggttcctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccag

SEQ ID NO: 122515 - DNA, 2491 bp, Homo sapiens
  Payload ID: 3994
  Gene Symbol: CRHR1
  Gene Name: corticotropin releasing hormone receptor 1
  ENST ID: ENST00000611599
  CDS Start-End: 483-1427
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122516 - DNA, 2664 bp, Homo sapiens
  Payload ID: 3994
  Gene Symbol: CRHR1
  Gene Name: corticotropin releasing hormone receptor 1
  Uniprot ID: P34998
  ENST ID: ENST00000613260
  CDS Start-End: 266-1600
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccaccgaccggctgcgcaaatggatgttcatctgcattggctggggtgtgcccttccccatcattgtggcctgggccattgggaagctgtactacgacaatgagaagtgttggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaacagctgtggctggggggatgacggccaggctccctgaccaccctgcctgtggaggtgacctgttaggtctcatgcccactcccccaggagcagctggcactgacagcctggggggggccgctcttcccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgccttctcccagagcacaagaaggccagcccactggggcctggggctgccctcggcaaccgtggggaggccatttgctgccctggggcatcatgggcaactcgtgacagcctctgactcaccacgatgatgcctctggacctcggtgatgccttccgacaccactgggaaccaagggccctcgctcaggaaccctggagacagaagtcaggtgtcatcatcagacttgcggccacagcactagagtcacccccccaggcctccagaacctcactggcactgtggcactgccaccagcaatgccctgccttgctgccttcaccctgaacatttactaccctgcaggccaggccagcttcccctcacttaaccaccccacaccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122517 - DNA, 2370 bp, Homo sapiens
  Payload ID: 3994
  Gene Symbol: CRHR1
  Gene Name: corticotropin releasing hormone receptor 1
  ENST ID: ENST00000619154
  CDS Start-End: 266-730
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 122518 - DNA, 777 bp, Homo sapiens; identical to SEQ ID NO: 122502
  Payload ID: 3994
  Gene Symbol: CRHR1
  Gene Name: corticotropin releasing hormone receptor 1
  ENST ID: ENST00000631395
  CDS Start-End: 1-459

SEQ ID NO: 122519 - DNA, 1272 bp, Homo sapiens; identical to SEQ ID NO: 122500
  Payload ID: 3994
  Gene Symbol: CRHR1
  Gene Name: corticotropin releasing hormone receptor 1
  ENST ID: ENST00000632957
  CDS Start-End: 1-157

SEQ ID NO: 122520 - DNA, 1206 bp, Homo sapiens; identical to SEQ ID NO: 122501
  Payload ID: 3994
  Gene Symbol: CRHR1
  Gene Name: corticotropin releasing hormone receptor 1
  Uniprot ID: P34998
  ENST ID: ENST00000633723
  CDS Start-End: 1-1206

SEQ ID NO: 122521 - DNA, 479 bp, Homo sapiens; identical to SEQ ID NO: 122504
  Payload ID: 3994
  Gene Symbol: CRHR1
  Gene Name: corticotropin releasing hormone receptor 1
  ENST ID: ENST00000632552
  CDS Start-End: 1-281

SEQ ID NO: 122522 - DNA, 2462 bp, Homo sapiens
  Payload ID: 3994
  Gene Symbol: CRHR1
  Gene Name: corticotropin releasing hormone receptor 1
  ENST ID: ENST00000632383
  CDS Start-End: 239-676
gccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggttcctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaacca

SEQ ID NO: 122523 - DNA, 223 bp, Homo sapiens; identical to SEQ ID NO: 122503
  Payload ID: 3994
  Gene Symbol: CRHR1
  Gene Name: corticotropin releasing hormone receptor 1
  ENST ID: ENST00000633333
  CDS Start-End: 1-223

SEQ ID NO: 122524 - DNA, 2695 bp, Homo sapiens
  Payload ID: 3995
  Gene Symbol:
  Gene Name: corticotropin releasing hormone receptor 1 [Source:EntrezGene
  Acc:1394]
  ENST ID: ENST00000634540
  CDS Start-End: 911-1633
ccacttctaggcttggttgaaccgtgcagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccag

SEQ ID NO: 122525 - DNA, 1600 bp, Homo sapiens
  Payload ID: 3996
  Gene Symbol: CRHR2
  Gene Name: corticotropin releasing hormone receptor 2
  Uniprot ID: Q13324
  ENST ID: ENST00000348438
  CDS Start-End: 71-1387
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagg

SEQ ID NO: 122526 - DNA, 3131 bp, Homo sapiens
  Payload ID: 3996
  Gene Symbol: CRHR2
  Gene Name: corticotropin releasing hormone receptor 2
  Uniprot ID: Q13324
  ENST ID: ENST00000341843
  CDS Start-End: 421-1614
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggcctccacactcagtggtgcccctgcagttgggtggggtacgccagcaaaggatcagtttggctgccttatcccaggggctgtcacctagagaggctcacttgtaccccacccttgttcctgtgtcccctccccagccatcctcccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaaccaaccatgtcttcagtgattgaaactcataccccattgccctttgccctccagtctccccttcagaaacatctctgctctctgtgaaataaaccatgcctcttggaagtggcctcccctcaggtcaagtcacccaggcacccgaagagtggtgtgggccaaggatcgtggctgggtctgagggggccacatccatcttccttagtgggctcgggccctggcctcgggccagttctctctctctctgacctctggtaggtttggagtctttatggtcaaagcacctgcaggcgggtctgtcccttatcactccaaccaggctaatacctggccccagcccccaaccaagggcagcttgattcagcctggaggaggtgtgcagctcatccagcaagccagggcctgtcccaaaggccaaggctctggaatctggtgggcagggtagacatggcccctcagttgaccaccagggcagcttccaggcttggcttccgtccctgtgtccctgcagcggagccgcaggagtcagggagagagaagcatcaggccatttcttccaaaagaaaccaatgctctaggtaccccctacaaaaataagttttgaaaaatcatgtatcccgtcttgcacatttttaagttgacatgtagtattttttacttaagttttaaatccttcaaaggtgtgatttctgccattttgtaaatatttacatttttaaataaaactgctgcaacaatttaaaatac

SEQ ID NO: 122527 - DNA, 309 bp, Homo sapiens
  Payload ID: 3996
  Gene Symbol: CRHR2
  Gene Name: corticotropin releasing hormone receptor 2
  ENST ID: ENST00000445981
  CDS Start-End: 13-309
gccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcagtcacgccgggcgcgcactcccactccctctccgcacgcggctgcgggacgcgatggacgcggcactgctccacagcctgctggaggccaactgcagcctggcgctggctgaag

SEQ ID NO: 122528 - DNA, 1787 bp, Homo sapiens
  Payload ID: 3996
  Gene Symbol: CRHR2
  Gene Name: corticotropin releasing hormone receptor 2
  ENST ID: ENST00000452278
  CDS Start-End: 31-225
tccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagg

SEQ ID NO: 122529 - DNA, 536 bp, Homo sapiens
  Payload ID: 3996
  Gene Symbol: CRHR2
  Gene Name: corticotropin releasing hormone receptor 2
  ENST ID: ENST00000423776
  CDS Start-End: 13-207
gccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggctggtcttgaattcctgtgctcaagcaatctgcctaccttggcttccccaagtgctgagattatgggtgtgagccactgcacctggccaagaatccgaatggattcaaagataccttgaaataattcctcaatgcaacacacacacatatgccagggttggtcaaatgggaagagagccttggcctgaagacagggacctgggctttcctcagctcttctgccaagtcacgccgggcgcgcactcccactccctctccgcacgcggctgcgggacgcgatggacgcggcactgctccacagcctgctggaggccaactgcagcctggcgctggctgaag

SEQ ID NO: 122530 - DNA, 2530 bp, Homo sapiens
  Payload ID: 3996
  Gene Symbol: CRHR2
  Gene Name: corticotropin releasing hormone receptor 2
  Uniprot ID: Q13324
  ENST ID: ENST00000471646
  CDS Start-End: 419-1654
agcattccgtcaccccaggcccacgctctccagcccaccgccctcctctggacgccgcgagtggaagagagctgcgaactgagaagccgtactttgggcagggtggagggcccgggggctggagactgagcccctccgagaggagccgcccggccccgccccccggcgcagccattggccgcggcggagcggctgtacccgcagctccgtgcactcggcggctcctctccgggaaggtccccacttgacagctctgggcgaccggaggtggcgcccaaaggctgcccgggagatcggggctgggctggcgggggccaggaccccgcgccctctcggccgctcactctcgcgtccactccctcgcagtcacgccgggcgcgcactcccactccctctccgcacgcggctgcgggacgcgatggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggcctccacactcagtggtgcccctgcagttgggtggggtacgccagcaaaggatcagtttggctgccttatcccaggggctgtcacctagagaggctcacttgtaccccacccttgttcctgtgtcccctccccagccatcctcccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaaccaaccatgtcttcagtgattgaaactcataccccattgccctttgccctccagtctccccttcagaaacatctctgctctctgtgaaataaaccatgcctcttgg

SEQ ID NO: 122531 - DNA, 3109 bp, Homo sapiens
  Payload ID: 3996
  Gene Symbol: CRHR2
  Gene Name: corticotropin releasing hormone receptor 2
  Uniprot ID: Q13324
  ENST ID: ENST00000506074
  CDS Start-End: 246-1409
attggccgcggcggagcggctgtacccgcagctccgtgcactcggcggctcctctccgggaaggtccccacttgacagctctgggcgaccggaggtggcgcccaaaggctgcccgggagatcggggctgggctggcgggggccaggaccccgcgccctctcggccgctcactctcgcgtccactccctcgcagtcacgccgggcgcgcactcccactccctctccgcacgcggctgcgggacgcgatggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagagagctgggtgagcaaggaagcccaggccgcagggcctcatggaagagagaagccagagcagaggtggtgacagaaggaagcttccagaaagagatgtgtgccaagcaatcaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggcctccacactcagtggtgcccctgcagttgggtggggtacgccagcaaaggatcagtttggctgccttatcccaggggctgtcacctagagaggctcacttgtaccccacccttgttcctgtgtcccctccccagccatcctcccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaaccaaccatgtcttcagtgattgaaactcataccccattgccctttgccctccagtctccccttcagaaacatctctgctctctgtgaaataaaccatgcctcttggaagtggcctcccctcaggtcaagtcacccaggcacccgaagagtggtgtgggccaaggatcgtggctgggtctgagggggccacatccatcttccttagtgggctcgggccctggcctcgggccagttctctctctctctgacctctggtaggtttggagtctttatggtcaaagcacctgcaggcgggtctgtcccttatcactccaaccaggctaatacctggccccagcccccaaccaagggcagcttgattcagcctggaggaggtgtgcagctcatccagcaagccagggcctgtcccaaaggccaaggctctggaatctggtgggcagggtagacatggcccctcagttgaccaccagggcagcttccaggcttggcttccgtccctgtgtccctgcagcggagccgcaggagtcagggagagagaagcatcaggccatttcttccaaaagaaaccaatgctctaggtaccccctacaaaaataagttttgaaaaatcatgtatcccgtcttgcacatttttaagttgacatgtagtattttttacttaagttttaaatccttcaaaggtgtgatttctgccattttgtaaatatttacatttttaaataaaactgctgcaacaatttaaaatac

SEQ ID NO: 122532 - DNA, 1130 bp, Homo sapiens
  Payload ID: 3997
  Gene Symbol: CORT
  Gene Name: cortistatin
  Uniprot ID: O00230
  ENST ID: ENST00000377049
  CDS Start-End: 506-823
atagtagaagaatgtctctgaaattactggatgagtttcagtcatactttcacatgggcacaatttcacattcaagctccttatcctaggctaattttatattatgttaaatcacttgtttttgttctcacggcttcctgcctgctataggcataattacgaggaagcagaacttctccagaagcaagcgcacatgcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaa

SEQ ID NO: 122533 - DNA, 2873 bp, Homo sapiens
  Payload ID: 3998
  Gene Symbol: COX10
  Gene Name: COX10 heme A:farnesyltransferase cytochrome c oxidase assembly factor
  Uniprot ID: Q12887
  ENST ID: ENST00000261643
  CDS Start-End: 78-1409
ggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcagagtggcacttggtggccagaaagtgtgagcctcatgatctgctgtctgtagttctgtgagctcaggtccctcaaaggcctcggagcacccccttcctggtgactgagccagggcctgcatttttggttttccccaccccacacattctcaaccatagtccttctaacaataccaatagctaggacccggctgctgtgcactgggactggggattccacatgtttgccttgggagtctcaagctggactgccagcccctgtcctcccttcacccccattgcgtatgagcatttcagaactccaaggagtcacaggcatctttatagttcacgttaacatatagacactgttggaagcagttccttctaaaagggtagccctggacttaataccagccggatacctctggcccccaccccattactgtacctctggagtcactactgtgggtcgccactcctctgctacacagcacggctttttcaaggctgtattgagaagggaagttaggaagaagggtgtgctgggctaaccagcccacagagctcacattcctgtcccttgggtgaaaaatacatgtccatcctgatatctcctgaattcagaaattagcctccacatgtgcaatggctttaagagccagaagcagggttctgggaattttgcaagttatcctgtggccaggtgtggtctcggttaccaaatacggttacctgcagctttttagtcctttgtgctcccacgggtctgcagagtcccatctgcccaaaggtcttgaagcttgacaggatgttttcattactcagtctcccagggcactgctggtccgtagggattcattggtcggggtgggagagttaaacaacatttaaacagagttctctcaaaaatgtctaaagggattgtaggtagataacatccaatcactgtttgcacttatctgaaatcttccctcttggctgcccccaggtatttactgtggagaacattgcataggaatgtctggaaaaagcctctacaacttgttacagccttcacatttgtacaattcattgattctcttttccttccacaataaaatggtatacaagaa

SEQ ID NO: 122534 - DNA, 875 bp, Homo sapiens
  Payload ID: 3998
  Gene Symbol: COX10
  Gene Name: COX10 heme A:farnesyltransferase cytochrome c oxidase assembly factor
  ENST ID: ENST00000429152
  CDS Start-End: 111-626
ggcccggaactactcccacaggggggcggggaaggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacaggtactttgtttttctgatatacttacttatttgaaactctatctttagtgaaacaaaaagctaattttatttaccacctgaaaagaataatttggaactgcaggtcctgtcttagtatttttcctctcttcaatttaactgggatttgaaattaaattttctgaattctatttacacagaattgtaaatagtattgcattgtaagtattgtattaaaaatagtcaccctttcctttgcaattaaagttgaatgtttatcctgctta

SEQ ID NO: 122535 - DNA, 1384 bp, Homo sapiens
  Payload ID: 3998
  Gene Symbol: COX10
  Gene Name: COX10 heme A:farnesyltransferase cytochrome c oxidase assembly factor
  ENST ID: ENST00000580561
  CDS Start-End: 3-191
ttatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcag

SEQ ID NO: 122536 - DNA, 1509 bp, Homo sapiens
  Payload ID: 3998
  Gene Symbol: COX10
  Gene Name: COX10 heme A:farnesyltransferase cytochrome c oxidase assembly factor
  ENST ID: ENST00000581931
  CDS Start-End: 3-509
ttatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggt

SEQ ID NO: 122537 - DNA, 2497 bp, Homo sapiens
  Payload ID: 3999
  Gene Symbol: COX11
  Gene Name: COX11 cytochrome c oxidase copper chaperone
  Uniprot ID: Q9Y6N1
  ENST ID: ENST00000299335
  CDS Start-End: 140-970
cgactgcaagcgctgccacctgaggagcctggtagccaaggcagcggcaggctcaacccagatctcgcgagacggagcacgcctcgcgagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagta

SEQ ID NO: 122538 - DNA, 1054 bp, Homo sapiens
  Payload ID: 3999
  Gene Symbol: COX11
  Gene Name: COX11 cytochrome c oxidase copper chaperone
  Uniprot ID: Q9Y6N1
  ENST ID: ENST00000572558
  CDS Start-End: 9-704
agagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattg

SEQ ID NO: 122539 - DNA, 2663 bp, Homo sapiens
  Payload ID: 3999
  Gene Symbol: COX11
  Gene Name: COX11 cytochrome c oxidase copper chaperone
  Uniprot ID: Q9Y6N1
  ENST ID: ENST00000576370
  CDS Start-End: 8-838
gagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaa

SEQ ID NO: 122540 - DNA, 1108 bp, Homo sapiens
  Payload ID: 3999
  Gene Symbol: COX11
  Gene Name: COX11 cytochrome c oxidase copper chaperone
  ENST ID: ENST00000571584
  CDS Start-End: 58-750
ctcgcgagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacaggtacatcaaagtgtaaactttacagaatatgataaagatacatgaaacggtttagtatgaaacttagtgttttagtagatcttgtgatttctgaaaacgaatttcttctaaacatcaagctatttttcttcactatctatacctgctatgcagagattgagaaccaaaccaaatggatatctgcttttaagattagaatttgttcttcatccttaaagcagaactcattgagatgaaaagatgctcttaatttatcacagaactgtgtatttaatagtatgcttattaaaatcacgaagtgtactggaatgctaagataaaagaactgtatagtttctgttatgtaatacgagaatagaaatgttattaaaatctttctataatttccagtgcttctgttttg

SEQ ID NO: 122541 - DNA, 495 bp, Homo sapiens
  Payload ID: 3999
  Gene Symbol: COX11
  Gene Name: COX11 cytochrome c oxidase copper chaperone
  ENST ID: ENST00000574821
  CDS Start-End: 1-154
tgcactggcgttttacagagctaagaatcctactgacaaaccagtaattggaatttctacatacaatattgttccatttgaagctggacagtatttcaataaaatacaggtattgtcttccaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttact

SEQ ID NO: 122542 - DNA, 708 bp, Homo sapiens
  Payload ID: 4000
  Gene Symbol: COX14
  Gene Name: COX14 cytochrome c oxidase assembly factor
  Uniprot ID: Q96I36
  ENST ID: ENST00000317943
  CDS Start-End: 301-474
ggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccagtgcctctccatgagaccataagctcctgtatgacagaagccatgttctttttagcggcctccgtagcatgatgggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 122543 - DNA, 739 bp, Homo sapiens
  Payload ID: 4000
  Gene Symbol: COX14
  Gene Name: COX14 cytochrome c oxidase assembly factor
  Uniprot ID: Q96I36
  ENST ID: ENST00000550487
  CDS Start-End: 332-505
ggaagttcaaagccggcctccagccagagtgacggcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 122544 - DNA, 677 bp, Homo sapiens
  Payload ID: 4000
  Gene Symbol: COX14
  Gene Name: COX14 cytochrome c oxidase assembly factor
  Uniprot ID: Q96I36
  ENST ID: ENST00000548985
  CDS Start-End: 270-443
gtggcctcgagaccctgcctgcctgaggaggcctcggttggatgcgaaggagctgcagcatccaggtacgctgccggctagggccgagcaggggctgccagtcccactgcctgcgcgcccacctgggccagtctccgcttgccgcgtcctcccatcccctagtctgcaggcctggtgcccttgaattcacccgcttctgttgcgttgcggaccgcgagctgcactgcttcctgcccaagcccaagctcctcgcagcagtaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 122545 - DNA, 580 bp, Homo sapiens
  Payload ID: 4000
  Gene Symbol: COX14
  Gene Name: COX14 cytochrome c oxidase assembly factor
  Uniprot ID: Q96I36
  ENST ID: ENST00000550654
  CDS Start-End: 167-340
tgcgttcggctgtgctgggaagttgcgtagacagtggcctcgagaccctgcctgcctgaggaggcctcggttggatgcgaaggagctgcagcatccaggcgcggtggctcacgccgtaatcccagcactttgggaggccaaggcgagtggatcacaaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgtctgtg

SEQ ID NO: 122546 - DNA, 1717 bp, Homo sapiens
  Payload ID: 4001
  Gene Symbol: COX16
  Gene Name: COX16 cytochrome c oxidase assembly homolog
  Uniprot ID: Q9P0S2
  ENST ID: ENST00000389912
  CDS Start-End: 145-465
attcactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatattattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattagggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgttcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttga

SEQ ID NO: 122547 - DNA, 384 bp, Homo sapiens
  Payload ID: 4001
  Gene Symbol: COX16
  Gene Name: COX16 cytochrome c oxidase assembly homolog
  ENST ID: ENST00000555601
  CDS Start-End: 4-81
ctcatgtttgcacccgcggtgatgcgtgcttttcgcaagaacaagactctcggctatggagtccccatgttggtgtactaggatctgtctgcttgtgagcgtggcgtctttcccatcgtcgaacgcggtcattgttactacccttgattcacaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatattatta

SEQ ID NO: 122548 - DNA, 684 bp, Homo sapiens
  Payload ID: 4002
  Gene Symbol: COX17
  Gene Name: COX17 cytochrome c oxidase copper chaperone
  Uniprot ID: Q14061
  ENST ID: ENST00000261070
  CDS Start-End: 94-285
gcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaagatcttcagttgtgtttcttttttgtgttcctcatttgctcacgtggctttttcccccaaaggatatataccaacaaatcttgtaacataaggttcttatgttcttattactatgtcattctgggaactctggatatctgttgtcaggagaaagcagatactgacctcaaccaatgaaatctccagaattaggtgcatagaagtaaaataaccctttaccaattcagaatcagtgtggtagccatatcatctcattcaaca

SEQ ID NO: 122549 - DNA, 430 bp, Homo sapiens
  Payload ID: 4002
  Gene Symbol: COX17
  Gene Name: COX17 cytochrome c oxidase copper chaperone
  ENST ID: ENST00000486606
  CDS Start-End: 1-176
actcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatgggtctcactctgttacccaggctggggtgaagtggcccaatcacagctcattgcagcctcaacctgggaggttcaggtgatcctcccctcagcctcctaagtaactgggactacaggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 122550 - DNA, 471 bp, Homo sapiens
  Payload ID: 4002
  Gene Symbol: COX17
  Gene Name: COX17 cytochrome c oxidase copper chaperone
  ENST ID: ENST00000484810
  CDS Start-End: 37-333
ggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtggtttcgtggtcgggtctctgttgacttatcccgtagcttagtaccgggaaacgatggagagagaggagaacggcaagcttcaaccactcattccttcctacaaattatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 122551 - DNA, 555 bp, Homo sapiens
  Payload ID: 4002
  Gene Symbol: COX17
  Gene Name: COX17 cytochrome c oxidase copper chaperone
  Uniprot ID: Q14061
  ENST ID: ENST00000468918
  CDS Start-End: 145-336
tttaaattccccacctgtcagagagaagcaggacttcctgtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacct

SEQ ID NO: 122552 - DNA, 660 bp, Homo sapiens
  Payload ID: 4002
  Gene Symbol: COX17
  Gene Name: COX17 cytochrome c oxidase copper chaperone
  Uniprot ID: Q14061
  ENST ID: ENST00000497116
  CDS Start-End: 55-246
cgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatgggtctcactctgttacccaggctggggtgaagtggcccaatcacagctcattgcagcctcaacctgggaggttcaggtgatcctcccctcagcctcctaagtaactgggactacaggtgtgggccaccgtgcctggctaattttttgtgttgttttttagagatggggtttcaccatcttgcccaggctggtctcaacctcttggactcaggcaatcctcctgccttggtctcccaaagtgctgggattaagaggtgtgagccactatgcctggccaagaaatgcttttaagtagggagtgggtatcccacggaagtattgctttctgaaaaatgaaaatggaattgtagcatgctttattcgaataaaactaaagcctcaggccattttttttttaattaaaaagtaaa

SEQ ID NO: 122553 - DNA, 513 bp, Homo sapiens
  Payload ID: 4002
  Gene Symbol: COX17
  Gene Name: COX17 cytochrome c oxidase copper chaperone
  ENST ID: ENST00000490145
  CDS Start-End: 1-137
cgggaaacgatggagagagaggagaacggcaagcttcaaccactcattccttcctacaaatgtgtgttgagtatctgttatgggttaagcactgcgttaggtccgaagatgtagacatggataaagatgcatcttgatataaaggagcttaaagttaatggagacataaaccagtgacttgtatacgacgtgtatcatcgagaaaggagaagaacactgtggacatctaattgaggcccacaaggaatgcatgagagccctaggatttaaaatatgaaatggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggaggggg

SEQ ID NO: 122554 - DNA, 6846 bp, Homo sapiens
  Payload ID: 4003
  Gene Symbol: COX18
  Gene Name: COX18 cytochrome c oxidase assembly factor
  Uniprot ID: Q8N8Q8
  ENST ID: ENST00000295890
  CDS Start-End: 93-1094
gttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgcctgtaatcccagcactttgggaggtcgaggtgggtggatcacctgaggtctggagtttgagaccagcctggccaacatggtgaaaccctgtctgtactaaaataacaaaaaaattagctgggcttagtggcaggtgcctgtaatcccagctacttgggaggctgaggcaggagaatcgcttgaacctggaatacagaggtttcagtgagctgagatcaccccattgcactccagcctggacaacaagagtgaaacgctatcaaagaaaaaaaaaagatgtaatccagatatatttgacagtaattaaaatcttttaaatgttataaatgcagtatgtttgtgaaagtattagaatagaaccaaagtgcctgtctctgtttataaagttacagtttgttagagctaccagaactttggagaatagggttagctactgaatgatggcaagttaaactaaacaatactgcatattactgttttgtaaaataagaggatcagtgagatgattcatgttttttttttttgagatggagtctcactgtgtcacccaggctggagtgcagtggcgcaatctcagctcactgcaacctccatctcccggattccagtgattttcctgcctcagcctccaagtatctgggattgcaggtgcacaccaccacgcccagctaatttttgtatttttagtagagatggggtttcaccatgttggacaggctggtctggaactgctgacctcaactaatccaccctccttggcctcccatagtgctgggattacaggcatgagccacctcacccagcattttttttttttaatttttttaatgagacagagtctctctctgtcacctaggctggagtgcagtggcacgatctcggctcactgcaacctctgcctcccgtgttcaagcaattctcctacctcagcctactgggtagctgggactacaggggtgcaccaccatgcccagctaagttttgtatttttagtagagatgggatttcaccatgttggctaggctggtcttgaactcctggcctcaagtgatctgcccaccttggcctcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattcattagtcatttctttgattgatgtctcttaaattttagttcacctgcttaatgaagttatgacattttttaatagaaaaaatgtacagcatacagaggtaagaattctgcttccctgagaatttattttagacatagatggtggcaattaagactaggttcttttttcatacaagttcctagtcctggtttctgactgtcctattggggcaattgtgctttccaaccacattgaaggaattgaaatatcctcattatttgtggattttatatttgtaaatttgcctccttgctcaaatctatccataaccccagaaccagtacttgcacaagtgcttttgagccatttgtaggcaaaaatgtgagtcacctcccaacagaagtgaaacaaatggtactctgccttctagtttcagctctcataccgtaaacatgtatcctttttgagtctacttagtcccatctcttcctaatttctgttctttttgttggtgattttactgtttaaaatggcctccaaatgccctgctggagtgctttctgatgttcctaagctcaggaaggcttaggagaaaataagtatattagataagcttcattcatgcacaagttataatgctgttggcagagagttcagtgttactgaatcaacaatatgttgcattgttctgttgacaaaaacaaagcttgcagaaacctaaccctgtatgttttctaggagcagtgatttggtattcactacttcagtgtttgtggactttatggaacataagtaccacaaataatgcaaattgactatatttgcagcgtgtacaatcaaggatgcagaggcagaaatgtgtgtgcagcttaggtcatagtaaaaagaggaaagaatttgaggaaaattttgccagttacatattacctctggaataactttgcctttgccgtgtgtgttactgtgtacactcagatatttttctcataatggcctttgccgtgtgtgttactgagtgagtacactcagatatttttctcataatggcatgagggaaatcagtctccttttcccattgtgtttgtcacttttgctgagacgcaaaaaataacgtgctatgatattgtgaaatatgtatttggtctttatccccaatccctgacatccagcggaatctgcagagttaagtgtcttttgtatgctcatgtgatgactggtggctgggggcccctagaaagtttcaggatagggcagatccttgtggccaggagttccagatcagcctgggcaacatagtgagaccttgtctgtacaaaaaagaaagtaggaaaaaacatctttggtttttcctatctccagatacttccttttcaaataaatgaatcttctttcatgtgcataatttaccttgtttactgtgagtccccttgatttcaaaatgtatatttgtatctttacaaatgtatattgtgcttagtttcctgttgctctcccattgtcaaactttcaaacttgaaatttcttttcaaatatatacaggaagtttgagaatacaaggcccttcctccaagatctcaaaataatttctcacaagtgggggttgctgggatcttgggataaacccatgtataaagaaaactggtgtattatgaactgaagtgaatcagttacctgaacttacctgacttcaggatggtaaatactcttgatttttttcttcaggcagattttttttagtaaagagcaaaaaatctgtattgtatttcagaaaattgcaagtctgtggtcttatttctaacagtttgtcatagcctggagcagttccagaacctgaatgaagtcagggctacagaacagggaatatgcatgctcttaagaccccttgatgtcttgctgtctggcttgcctatatcccctcagttgctgaggctctgcgctgggccctgcagagttcaggaaggtttttgtctccttagatgaggactgtaatgtttgtgttacccttccccacaggggtgttacccacccttctcgtccttacaggagatctgtttttcctgtgggtctcatttttgtctctaggccagattcactgtcttaatgaatgcttctcatttcaagagtcaggaagggagactcactcctggatcaatttatagtatttataccattaggatacctgagttcaaaagtatattaatagatagaattggcgtatctgaaatgatcccaaattacttttccctgggaccgttagaagagaaaactgaacaaatcccatcctagtcagatgtcctaagtgggaagatgaggcttacaaaggaaaaccaaaattcttaattgccaccctgacagataacccaggagaaggtgcaaagcctcattaagaacctcgagggaaaagccaaacttggggagaagacttttcaggtacctttaacagcacttaagagctaaagaccatatcttcatctaagaaccacccatttacccgtccaaaccgaaagaacagacttggagacctgaagaacagtggaagcaagacttttaatggcagtcttgcaagattgggtgtctggtgggcaggcacacctggggcagttacagcaggtaatttatctcctagcacacaagtccttcccccagtttctgattggttaagtactatgggattacagtcttcccagacatcgcgtaagtttcattatcccccttgtaaggttatataccccattcccttccccccttaagttttgatttcccaataacgaaactttcttcccttttatgggctgactcctcctctacattctgttcgtttattgtgaccttctaggtgcatgagcagtgcggtttgttacataccaaggctggctgccagtgcttagatttatcatgccttgaaaatggaccatttaaaatgttttcccacagttcacatctcagaggaggtacagaggtcctcctagatgacattgggaaaattgtagttagtgtgaaaaaatgagtgcccaaaaaaaccttggtaccttctgtgttttgttcctattttttttttattggacgcataatctgcttatattttgcacctattcttaaatcacacttataccttcatattttattcttctaagaatcccaggaatcaccttttttttttttttaggagtcacctttaaaattgcctatatgtcagatttaagtcccagaagcagtaggaatgcagaccctagaaaaaaaattaaagaatgtagtttattttttcctctggggtgttaactgcagctactacagaatgcagactttggaatttcaggcataacatctgaaaccatgcaagaatttagatttctgtattaaagctaaatcttcatgtaaatatggtgtaaaacaatgcattatcattataaacactgtgccttacgagctggttcaagcagaacccagataattggaaattatatgaatttatagattttccatttgaaccttattagtgttgtttaaacttgtaataatggatattttctagttatctgttttctttttttcatacactgtgatggtattttatgaaatcatttggttttgggaagttggaatttcctaaagccacagcattaaagtcagataattttatttacccaaaagtttctggaacgctgtggttctgtactgtgtatacaactaaaataagaatataaatttatataaaaataaaaatacaactatataagtaa

SEQ ID NO: 122555 - DNA, 3027 bp, Homo sapiens
  Payload ID: 4003
  Gene Symbol: COX18
  Gene Name: COX18 cytochrome c oxidase assembly factor
  Uniprot ID: Q8N8Q8
  ENST ID: ENST00000449739
  CDS Start-End: 93-482
gttgctggcgcgtgcgcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgcctgtaatcccagcactttgggaggtcgaggtgggtggatcacctgaggtctggagtttgagaccagcctggccaacatggtgaaaccctgtctgtactaaaataacaaaaaaattagctgggcttagtggcaggtgcctgtaatcccagctacttgggaggctgaggcaggagaatcgcttgaacctggaatacagaggtttcagtgagctgagatcaccccattgcactccagcctggacaacaagagtgaaacgctatcaaagaaaaaaaaaagatgtaatccagatatatttgacagtaattaaaatcttttaaatgttataaatgcagtatgtttgtgaaagtattagaatagaaccaaagtgcctgtctctgtttataaagttacagtttgttagagctaccagaactttggagaatagggttagctactgaatgatggcaagttaaactaaacaatactgcatattactgttttgtaaaataagaggatcagtgagatgattcatgttttttttttttgagatggagtctcactgtgtcacccaggctggagtgcagtggcgcaatctcagctcactgcaacctccatctcccggattccagtgattttcctgcctcagcctccaagtatctgggattgcaggtgcacaccaccacgcccagctaatttttgtatttttagtagagatggggtttcaccatgttggacaggctggtctggaactgctgacctcaactaatccaccctccttggcctcccatagtgctgggattacaggcatgagccacctcacccagcattttttttttttaatttttttaatgagacagagtctctctctgtcacctaggctggagtgcagtggcacgatctcggctcactgcaacctctgcctcccgtgttcaagcaattctcctacctcagcctactgggtagctgggactacaggggtgcaccaccatgcccagctaagttttgtatttttagtagagatgggatttcaccatgttggctaggctggtcttgaactcctggcctcaagtgatctgcccaccttggcctcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaactaaagtgaaattca

SEQ ID NO: 122556 - DNA, 1083 bp, Homo sapiens
  Payload ID: 4003
  Gene Symbol: COX18
  Gene Name: COX18 cytochrome c oxidase assembly factor
  Uniprot ID: Q8N8Q8
  ENST ID: ENST00000510031
  CDS Start-End: 78-461
gcgtatcagccttggctggccggtgtatgtccgctggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaagctaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatga

SEQ ID NO: 122557 - DNA, 1086 bp, Homo sapiens
  Payload ID: 4003
  Gene Symbol: COX18
  Gene Name: COX18 cytochrome c oxidase assembly factor
  ENST ID: ENST00000507544
  CDS Start-End: 44-1048
tggattgtgaggcccgggatctgggctccgccgtggtgcagaaatgctgtgccggctcggcggtcggtggctgcggccgctccctgccctgcagctttgggctagggacctgccgcttgcgccggttcctacgagcggcgccaagcgccccactctcccagtgtgggcagtggcaccagtctctgcagtacatgcgaacggctggtacgaggccctggccgcgtcttcgccggtgcgggttgcggaggaagtactgctcggcgtgcacgccgccacgggcctgccctggtggggcagcattctgctctccaccgtggccttacggggtgctgtcacgctgcctttggcagcctaccagcactacatcctggccaaggtggaaaatttgcagccagaaataaaaactattgccaggcatcttaaccaagaagttgcagttcgtgcaaatcagttggggtggtccaaaagagatgccaggctcacttatctaaagaatatgaggaggctaatttcagagctatatgtgcgagataactgccaccctttcaaagccactgtgttggtttggattcagcttccaatgtggatcttcatgtcttttgctctccggaatttaagcacgggggcagcacattcagaagcaggtttttctgttcaggaacagttagctactggtggaattctgtggtttcctgacctcactgcacccgactccacttggattctgcctatctctgttggcgtcatcaatttgttaatagtggagatttgtgctctacaaaaaattggaatgtctcgttttcagacgtatattacgtactttgtccgtgcaatgtcggtgttgatgataccaattgctgcaacggtaccctcatcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtca

SEQ ID NO: 122558 - DNA, 3666 bp, Homo sapiens
  Payload ID: 4004
  Gene Symbol: COX19
  Gene Name: COX19 cytochrome c oxidase assembly factor
  Uniprot ID: Q49B96
  ENST ID: ENST00000344111
  CDS Start-End: 91-363
gtgctcggcgctcccggggtgcctgctcggcgctccgccggccgccctgcgtacgctcgcaaggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggcctgcgtgtggtgtccttagaaatgggcttcgaatagaagctccagccctgtgggggcgtctcctgggtagggagtggcgtcccgttttcccttaggagggtgtttctgcattgaacccctgagtgggacggcgttcccggcaaagctgggagggaggcgagcgtggggcaagacccttgtcttcgaggccggggccctcttgtatggggcggttttatgttgcagtcctctgatactttctgagttcaaagaggtaaatgtataaatttcagtcccttctgaacacagatatcatcagaaaattaccattccctagcaggatgttttcgtgtttgtattcgtatatgccagttcatttcctttgaaaaaaaaaaaaagtggaacacaaagtaggaagtgagaaccttctggctttggatggattgacttcttgattctttctggttttgcctgaacaccaagtagcttcataatcaaagggtcattttctggtttgtatcagaccgtatttataaagttgggtatttaatttcagtaactcctgtattttaacagaaaaagaacctgagtccatttgcagttaggctcgcaccagctgtcttctgtgccagccagctccgcccgagaccccggcacgtgttcgcagcacagcctggcaggggccctgagcggagttctcagcccgtctgtgccaaagttgcctgtgggtcacggaaacccggcccatgtccacccagtgcgtcaggccagccggggcccaaacctgtggatggaacgcaggtgcctgcacatctggggcctcagccagacctgtctccttcccaggcactgtcggaaaggggctggctcctgtctggtcagtggaggatggtggcaggagacggggtggggaggtccaggtcacgtcctctctggcgaccctggcagtggctgtctccaagccctggcaggtggggccaccaatctggccgacctcaggctctgggaaacaggctgccctcgtccctctgcctgtgggtggctgaggcttctcagcccatctccagttctctgcagcaaaggccctctgtttctgtcctgcagtggtggccctttcgtggttaaacatgtccctcccctcctcacagaactgagtacctattgcggctgggcccgcccaaccctgtgtccctgcacccatgggttctaccacctgattcggctgcagctgtcactgtcccgtgtctgctctctgtcaggcctctgagtgctgcagacgtattaacatatcaccgctagttgatggaaagtcttgtttcttattagaatattttgtgtaggcacagggttgccccagcactgtctatagcaaccccagtgtcctcacagtgcacgtgagccgtgacgcagccaccgtggagtcggcgctgacgcggtgtggccacgtgccatgagctcgccaacgcagtgcggctatatggcgtgagcttactgtgaagtggagacaggcagggacacaggaaactacaaacgagaaatccagaaggaggagctggaactgatgggcatagccggccgcgagcccctccgagcacccctgggggtggagttctggctgtcatggcagagggtttcacatgctcaaaaagtaaatgaaccaggatgtgaggggaacacaacagaccatgccgacggagctcccgggcccaggccggggcctcttcccatcgcactctgacccgccgtcgggagtgcccaggcccgggtcgggcctgcctctccgctcgcaccgcactctgacccatcaggagtgtggggaagaccgtcgaccaaaggtgggaaagacaggaaagatactgtactctaagtagtaaatttgttttttgcgtggacgattctgaagctgtattctgagatggaaaaaactagaaatacatcgtggatgatgagagccaggtgtattgagctcctgcttttctaacgtacaaaggtaactggatagagaaacggagtgatcgccctcacctggccagggtgtgctccgagaccccagcaggtgccgaagccgcggatagtcccgaatcctgtccaggcgctgttttttcctgtacgtacctgtgatcaagtctgagatgtgacagcaaaactgacagaacttcgtgcttccctcttcaaaatgtcacagatgggcactgtgttcttaccggagatcttagcaacctcggcatctggctgtttttcttataggtcaggagtttccaccttttcccttaaaggaagcgcttggcagcttctctggtgtgtctgagtcgccagcatcaccactgtcctgttctggggccattcttaagtaaaataaaagcttcttggacccaagcaccacatcaccgcgatggctggtctgatcaccgagatggctgctgagtgcctggcaggcagggtggcgtggatggcccgaaacgctggacggagggagggttgatgtcccagcaggacggctgctcagaacagcacagaatcaaaaactcatgaatggtttatttctggaattttccacttagtatttttggactgtggctgaccatgggtaactgaaaccgtgtgtaagggggactgttgtgaggggctgtgcacaaatgcttcccagctcttgagggcctggacgcagtgacccgtgcactcagggtcttggccctgataccattctgtaaccaaaaggaaccagggccaggccagagaaggtatcagatgagctagagagtgaagaattgctgggatgaggagacttgttgaaataacacggggggatgggaaggagcatacggtggccagcctggggcagtgtgagcgtgaaaataaacaggctgggcgcagcggctcacgcctgcaatcccagcactttaggaggccaaggtgggaggatcacttgaggctaggagttcaagaccagcctgggcaacatgggtgaaaccctgtctctacaaaacaagaaaagtcagccgtgcgtggtgtcacccgcctgtagtcccagatactcaggaagctgaggcaggaggatcacttgagccagaggttaagtctgcagtgagctgtgattgtaccactgctctccagcctgagcaacagagccggaccctgtctcaccaaaggaaaaaaaaaaaaaaaaaagaaagaaaattaattattgtaatgggctgtagccctcagaataaattgatatccagtagtctatacaacataa

SEQ ID NO: 122559 - DNA, 1420 bp, Homo sapiens
  Payload ID: 4004
  Gene Symbol: COX19
  Gene Name: COX19 cytochrome c oxidase assembly factor
  ENST ID: ENST00000457254
  CDS Start-End: 41-409
gtacgctcgcaaggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttgagtccaaagtaccctccttctactaccggcccacgccctccgactgccagctccttcgagagcagtggatccgggccaagtacgagcgacaggagttcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaacagcacccgtaacatcttcatctaccatgaggacgggaaggagattgtggactggttcaatgcactccgagctgctcgcttccactacctgcaggtggcattcccaggggccggcgacgcagatctggtgccaaagctctccaggaactacctgaaggaaggctacatggagaagacggggcccaagcaaacggaaggcttccggaagcgctggttcaccatggatgaccgcaggctcatgtacttcaaagaccccctggacgccttcgcccgaggggaagtcttcattggcagcaaggagagtggctacacggtgctgcatgggttcccgccgtccacccagggccaccactggccacatggcatcaccatcgtcacgcccgaccgcaagtttctgtttgcctgcgagacggagtccgaccagagggagtgggtggcggccttccagaaggcggtggacaggcccatgctgccccaggagtacgcagtggaggcgcacttcaagcataaaccttagcgagtgcggctggaggaccacggacattggactcactgtggctggacggaggggacccgtggatgggggggctctggcgtcctgaggccacctggccccacctgctcctcagggcagcccggcgcggccaggtagggcccgag

SEQ ID NO: 122560 - DNA, 568 bp, Homo sapiens
  Payload ID: 4005
  Gene Symbol: COX20
  Gene Name: COX20 cytochrome c oxidase assembly factor
  Uniprot ID: Q5RI15
  ENST ID: ENST00000366528
  CDS Start-End: 100-492
gcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggcatcttgtacgtcgttacatttatcatattggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctct

SEQ ID NO: 122561 - DNA, 2631 bp, Homo sapiens
  Payload ID: 4005
  Gene Symbol: COX20
  Gene Name: COX20 cytochrome c oxidase assembly factor
  Uniprot ID: Q5RI15
  ENST ID: ENST00000411948
  CDS Start-End: 394-750
gcgccggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaa

SEQ ID NO: 122562 - DNA, 6254 bp, Homo sapiens
  Payload ID: 4006
  Gene Symbol: CXADR
  Gene Name: coxsackie virus and adenovirus receptor
  Uniprot ID: P78310
  ENST ID: ENST00000284878
  CDS Start-End: 749-1846
cagggctagaatagcctttctgtgcaagtggaaaaaacctcaggtatttcccaaatcggtagctgcagaggggctctatccctaccagagatggagaaaagccctctcgcgctttttatgtcagccagagcggctcgttaagagagcgaaggccaggggctgcacaggtcgcatcccgtgagcatgaggtcagagaacctgcccctggggcaaaccgcgaggggtgggacgggtgggtgcaggcggggcggagggtaggagccgccctagtggcggcccctgggagtgtcccgtgcctcgccttaaaggagggcgccaacgcaatttcagtatgtgggagacgggctgccccacccccgcgcgcaaaaccctggtttagcttaagggatggaggcggggacccctgcgcaggcttgcggcgtgggaggcggccgcccgcgacctacgacgccgcgcgccgggaggctgagagttcggcgccgggagggtcccggggacagaagagcgcctcgcccggttgccaaggcaaccccacgcggctggagaagccggcgctcgcagcccggcccgggccgctgccggaagtgacgcgagttcacctgccgagcgggggctgggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaaggaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatctttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaagagatacctgatttttattaaaaagatactttttcaaatttaagagttaatcttggaaatttggaacaagtaaaggggcaagtaaaccttttgatgaaatataaaaggaactcattgcatgaagttgactatcaaattctgtgatgtgtggcttcttaaaaatattctcagtgtcttttgtgtgcgtgcagcatgtacatttgatgttatgtgaatgttgagttttttcttctaattttcacttcagcagtgtttagggctttcagatgccttattccagtgtgaacagaaaaagttcatattttatgtggttaatgctttgatgtgtcacataaagagtagtttgtagaaaatgttggcacaattttaacttcttagtggcttgtgacattatatattatatatatatatgtacatatatctttataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaggaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtgaccttgtgtacttttgaaataaaatcaagaaagcagt

SEQ ID NO: 122563 - DNA, 270 bp, Homo sapiens
  Payload ID: 4006
  Gene Symbol: CXADR
  Gene Name: coxsackie virus and adenovirus receptor
  Uniprot ID: P78310
  ENST ID: ENST00000356275
  CDS Start-End: 1-270
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgggaagatgtgccacctccaaagagccgtacgtccactgccagaagctacatcggcagtaa

SEQ ID NO: 122564 - DNA, 603 bp, Homo sapiens
  Payload ID: 4006
  Gene Symbol: CXADR
  Gene Name: coxsackie virus and adenovirus receptor
  Uniprot ID: P78310
  ENST ID: ENST00000400165
  CDS Start-End: 1-603
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtag

SEQ ID NO: 122565 - DNA, 1080 bp, Homo sapiens
  Payload ID: 4006
  Gene Symbol: CXADR
  Gene Name: coxsackie virus and adenovirus receptor
  Uniprot ID: P78310
  ENST ID: ENST00000400166
  CDS Start-End: 85-843
cgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggtt

SEQ ID NO: 122566 - DNA, 1445 bp, Homo sapiens
  Payload ID: 4006
  Gene Symbol: CXADR
  Gene Name: coxsackie virus and adenovirus receptor
  Uniprot ID: P78310
  ENST ID: ENST00000400169
  CDS Start-End: 1-1059
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagttcaagtacccttacaagactgatggaattacagttgtataaatatggactactgaagaatctgaagtattgtattatttgactttattttaggcctctagtaaagacttaaatgttttttaaaaaaagcacaaggcacagagattagagcagctgtaagaacacatctactttatgcaatggcattagacatgtaagtcagatgtcatgtcaaaattagtacgagccaaattctttgttaaaaaaccctatgtatagtgacactgatagttaaaagatgttttattatattttcaataactaccactaacaaatttttaacttttcatatgcatattctgatatgtggtcttttaggaaaagtatggttaatagttgatttttcaaaggaaattttaaaattcttacgttctgtttaatgtttttgc

SEQ ID NO: 122567 - DNA, 2103 bp, Homo sapiens
  Payload ID: 4007
  Gene Symbol:
  Gene Name: CPEB2
  ENST ID: ENST00000634696
  CDS Start-End: 88-1857
ccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttc

SEQ ID NO: 122568 - DNA, 635 bp, Homo sapiens
  Payload ID: 4007
  Gene Symbol:
  Gene Name: CPEB2
  ENST ID: ENST00000634493
  CDS Start-End: 1-504
ataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgttgaaggaccgattatttggagcagagtactgactcttaaagagcaactcagttgcagagcagatgaattgagatacatgtgccttcttaaaaaggcattgaaatacctgagggaaaagcttattttctaagata

SEQ ID NO: 122569 - DNA, 2013 bp, Homo sapiens
  Payload ID: 4007
  Gene Symbol:
  Gene Name: CPEB2
  ENST ID: ENST00000634867
  CDS Start-End: 88-1767
ccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttc

SEQ ID NO: 122570 - DNA, 6797 bp, Homo sapiens
  Payload ID: 4007
  Gene Symbol:
  Gene Name: CPEB2
  ENST ID: ENST00000635362
  CDS Start-End: 1-3024
atgagggatttcgggtttggggtgctgcagaccgccccgctccgaagtagcagtcctgggcccctgttctgcggcgaggcgtatggtccttacgccgtggggtccgtcaacccgctgccctccgccacgcccttcggcccactgtcgccaccaccgttgcctgtcaccggcttcttagaggccgcctcccccttctccgtccccctcggcggcggcgcgggcagcccggccgccgccgcttcctcttcctccccgttcctggcgcatcagcagaccatgcaggatgagctgcttctggggctgacacagcagccggcgcggccgctttcgggggcggcggccacggagaaactccccgaccaccaccccggcggcggcacgatcgcgggtgtgacccacctcctcccctcccaggacttcaaaccgagtctgcaccacccctcctcctcctccgcctcctcctgctgctgctgccgcacctcctccccgcaggacttcagtaagcggcagcagcagcagctgagcagccagaagaggaaagagttcagccctccccaccttccccaccctccggactcgaagccgccgccgccgcctccgccgctccactgccccggtcggttcagcccgccgccgccgccagccggcccgctcctccagccggcgcagctcgctcagcgccagcagcaacagccgccgcagcagttcagcctcctgcatcagcagcacctctcgccgcaggacttcgccccgcggcagcgtccggcagacctgcccccgctcccgcagctccctccctcgccgcctgcagccccgcggcgccgccacggaggcgcgggcagccctcgcaagaccccagccgcgggcgagggcagcgccgccgagtcccccaatgcgggcttggcctcctcgacgccggtgaaccccgcgccgggctccatggagtcccccaaccaccctctgctcaacagtcccagtaacctcctgcccggaggtgcgcttggcgcgggcgccttcagcagcctgcagagcccggaccttccacacccgggcggcggcggcggcggcgggggcggggggcccccaggaggcggagggggaggcggctccgcgtcgccgccgccgctgcccggcttcggcaccccctggtcggtgcagaccgcgtcgccgccaccccagccccagcagccgccgccgacccagccgcagcagcagccgccgccaccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtaagaatggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcata

SEQ ID NO: 122571 - DNA, 5509 bp, Homo sapiens
  Payload ID: 4007
  Gene Symbol:
  Gene Name: CPEB2
  ENST ID: ENST00000635651
  CDS Start-End: 50-1738
ctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtaagaatggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggca

SEQ ID NO: 122572 - DNA, 5524 bp, Homo sapiens
  Payload ID: 4007
  Gene Symbol:
  Gene Name: CPEB2
  ENST ID: ENST00000635093
  CDS Start-End: 50-1753
ctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggca

SEQ ID NO: 122573 - DNA, 6878 bp, Homo sapiens
  Payload ID: 4007
  Gene Symbol:
  Gene Name: CPEB2
  ENST ID: ENST00000635061
  CDS Start-End: 1-3105
atgagggatttcgggtttggggtgctgcagaccgccccgctccgaagtagcagtcctgggcccctgttctgcggcgaggcgtatggtccttacgccgtggggtccgtcaacccgctgccctccgccacgcccttcggcccactgtcgccaccaccgttgcctgtcaccggcttcttagaggccgcctcccccttctccgtccccctcggcggcggcgcgggcagcccggccgccgccgcttcctcttcctccccgttcctggcgcatcagcagaccatgcaggatgagctgcttctggggctgacacagcagccggcgcggccgctttcgggggcggcggccacggagaaactccccgaccaccaccccggcggcggcacgatcgcgggtgtgacccacctcctcccctcccaggacttcaaaccgagtctgcaccacccctcctcctcctccgcctcctcctgctgctgctgccgcacctcctccccgcaggacttcagtaagcggcagcagcagcagctgagcagccagaagaggaaagagttcagccctccccaccttccccaccctccggactcgaagccgccgccgccgcctccgccgctccactgccccggtcggttcagcccgccgccgccgccagccggcccgctcctccagccggcgcagctcgctcagcgccagcagcaacagccgccgcagcagttcagcctcctgcatcagcagcacctctcgccgcaggacttcgccccgcggcagcgtccggcagacctgcccccgctcccgcagctccctccctcgccgcctgcagccccgcggcgccgccacggaggcgcgggcagccctcgcaagaccccagccgcgggcgagggcagcgccgccgagtcccccaatgcgggcttggcctcctcgacgccggtgaaccccgcgccgggctccatggagtcccccaaccaccctctgctcaacagtcccagtaacctcctgcccggaggtgcgcttggcgcgggcgccttcagcagcctgcagagcccggaccttccacacccgggcggcggcggcggcggcgggggcggggggcccccaggaggcggagggggaggcggctccgcgtcgccgccgccgctgcccggcttcggcaccccctggtcggtgcagaccgcgtcgccgccaccccagccccagcagccgccgccgacccagccgcagcagcagccgccgccaccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcata

SEQ ID NO: 122574 - DNA, 5612 bp, Homo sapiens
  Payload ID: 4007
  Gene Symbol:
  Gene Name: CPEB2
  ENST ID: ENST00000634532
  CDS Start-End: 50-1843
ctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattgg

SEQ ID NO: 122575 - DNA, 1630 bp, Homo sapiens
  Payload ID: 4008
  Gene Symbol: CPXCR1
  Gene Name: CPX chromosome region, candidate 1
  Uniprot ID: Q8N123
  ENST ID: ENST00000276127
  CDS Start-End: 260-1165
aggagtaagtggagaggtagagggcagaagaaaaggggtcaagaaggcaggaccccgtgaagcacacctttcctaaggattttgacgaatgagaatgaagataaactgtgagttgaaagtgaaagagaaagcataagggatcttaggtgcatctgacaagccttagatgacctccagcaacttcagttctcaccgaattactgcatttcagccttactgagaagcagccagtcatactatcctcaaattttaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacatagaaa

SEQ ID NO: 122576 - DNA, 1577 bp, Homo sapiens
  Payload ID: 4008
  Gene Symbol: CPXCR1
  Gene Name: CPX chromosome region, candidate 1
  Uniprot ID: Q8N123
  ENST ID: ENST00000373111
  CDS Start-End: 212-1117
ggagaggtagagggcagaagaaaaggggtcaagaaggcaggaccccgtgaagcacacctttcctaaggattttgacgaatgagaatgaagataaactggtgcatctgacaagccttagatgacctccagcaacttcagttctcaccgaattactgcatttcagccttactgagaagcagccagtcatactatcctcaaattttaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacat

SEQ ID NO: 122577 - DNA, 1485 bp, Homo sapiens
  Payload ID: 4008
  Gene Symbol: CPXCR1
  Gene Name: CPX chromosome region, candidate 1
  Uniprot ID: Q8N123
  ENST ID: ENST00000614120
  CDS Start-End: 115-1020
ggtgcatctgacaagccttagatgacctccagcaacttcagttctcaccgaattactgcatttcagccttactgagaagcagccagtcatactatcctcaaattttaacccaggatgagttatcctactaaagaaggaagtgatacagctggaaatgctcacaaaaattctgaaaatgagcctcctaatgactgtagtacagacatagagtctccatctgctgatcccaatatgatctatcaggtagaaaccaacccaataaacagggagccaggcacagcaacctcccaggaagatgttgttcctcaagcagcagaaaacagcgagctcgaaacagagatccaaaaagatcaacgagaagaagatctaaaagaagagcttcttctacttcagacccccattcccagaaaattggtctctcacaagcccttaaatgatagatcaagatcccactcagggaaagttgagatgaaagcaaacaatttccccataaatcacaaaactcgttttcgactttcaacttcatggagagtcccatttattaacagtcatgagataagaagtatgattctccatctgctatgtgatagatatttctctcaggctgcagggtgtcagaataccatgtgggtaaagcgaaaatatatagcatgtctttaccatccaaatagtttcacccatcacgagagagccataacatttagaaggccttcgagggtgcactactaccgtcccctcactgagagaatgacatcaggaaaattttgcaaatcaactgacactaaagggaaatgtagattccgtgctattgtgaggtctgtgctctttgtgtcacagatacaaattgaaagtatttttaatataaaaggttttgtggatatattgacatatatccataccatgaatgttatgatcacaaacaccaataatggttggaaatacttttgtcccatctgtggaaggctttttaacacttactctgaattaagacaacattcatgcagctcttctgggaattaaattaaattggggtaaattcattttaaaatataacttctaaaattcataatttgactactaaagtaagacaaaattgcatgaacataaattttagtattattagagggagtagcagaaaggaacacaaactaatagtacctctcagtaagaaatacctatggggagtgaggaaacatctgtttatactttgcttttacaagtacatcattgaaatatcagacctgtcatctatattgagtcagcatttgaaccaagtaaatgttttcactgtcttaacatctatttctgtagatgtaaatattgttaacataaaagaatccaagttaacaggatcctgactaagatagcaaacatatattggaaggccagacaaagttctaccaagtgtttccagagattctgctacatgtattatctgaaatgttctccatatattcaataaaaaccaatttgaagacatagaaa

SEQ ID NO: 122578 - DNA, 414 bp, Homo sapiens; identical to SEQ ID NO: 106200
  Payload ID: 4009
  Gene Symbol:
  Gene Name: CR388407.1
  ENST ID: ENST00000622450
  CDS Start-End: 1-414

SEQ ID NO: 122579 - DNA, 1228 bp, Homo sapiens
  Payload ID: 4010
  Gene Symbol:
  Gene Name: CR392000.1
  ENST ID: ENST00000624770
  CDS Start-End: 669-1172
gctggtatcaagatttattggcccaagcggtgacgacagatcagagcccaggcaaatacagcaggagaccttgaaggggaggaaccttggattaccatcttgcccggtcaatatatctgaatgccaaagccctccgctctgtatatgtcctgttgggagattaaatgcgtttacacctctgctgaagcggctttttctccggtgctcagagtaacctgacggctccggccccctccagggccgctgtccttggaagccctggcccgggttttccttcgttcctcacgaccagcccccttcaagggcaccctaccacctgccagcgacgcgaggcacctgctgggctcccagggaaagtcacgctggttccagctgtgactgcagccgccaccgcattgcgccgcacgtcagcaccaaccacgtggcagcgagcctgggagccatcagattcgctgcaaatctgcggggcttcagtggtggagatttatcgtcatgccagatgcgtgtgtgtgagatacataattcctctcacacggcctcataaatccaaaagggtcagcaataaatggaaaaaaataaaaaatcacagactaatttgttcagaagactagaaggggatcaatgagaaagctgtagctcagctcaaagtttgttctgaaattgggagcatggagcaggaacacattccccactggatccaaacatctgcattctcaggtgggctgggcaggagctggtgcaaaatcagatgcatggcccgagctgggcttcctgtgcacatggtgaatggggaccctgacacaggccggccattgttaacggcacctggggctaagcagccgccccggggctggagaaggcaggctgggtccagctgctcccgggcgaggggtgtctggagaggggctcttgcctcacggcagggggcccaaagaggttctaaggggcctggggtctctcaccagagctatggggtagagggccttggcagctccgtgtgtcctgtgacctggcatcttagggctttgccacgccagctttgtgatgcctcccaccagactgcatgcataaagtctggagtatgctcctctctgaagtggaggaggcctgaggccctggacaggagaagccacatcctggaaggatcagtgctgggacacagatgtccctaaggccaacacgctgctcatcaactccgcattcaagaagagaccctcagattcaaaag

SEQ ID NO: 122580 - DNA, 414 bp, Homo sapiens; identical to SEQ ID NO: 106200
  Payload ID: 4011
  Gene Symbol:
  Gene Name: CR547123.1
  ENST ID: ENST00000618974
  CDS Start-End: 1-414

SEQ ID NO: 122581 - DNA, 69 bp, Homo sapiens; identical to SEQ ID NO: 106199
  Payload ID: 4012
  Gene Symbol:
  Gene Name: CR753845.1
  ENST ID: ENST00000593842
  CDS Start-End: 1-69

SEQ ID NO: 122582 - DNA, 108 bp, Homo sapiens
  Payload ID: 4013
  Gene Symbol:
  Gene Name: CR759815.1
  ENST ID: ENST00000548618
  CDS Start-End: 1-108
tcacctccaccacctggagggggcgagaagcctctggccccgccccctggatgggtggagcctcctaagtggctgggactacagggacctagtggagggcctggggta

SEQ ID NO: 122583 - DNA, 108 bp, Homo sapiens; identical to SEQ ID NO: 122582
  Payload ID: 4014
  Gene Symbol:
  Gene Name: CR847794.1
  ENST ID: ENST00000552607
  CDS Start-End: 1-108

SEQ ID NO: 122584 - DNA, 414 bp, Homo sapiens; identical to SEQ ID NO: 106200
  Payload ID: 4015
  Gene Symbol:
  Gene Name: CR933783.1
  ENST ID: ENST00000616996
  CDS Start-End: 1-414

SEQ ID NO: 122585 - DNA, 7671 bp, Homo sapiens
  Payload ID: 4016
  Gene Symbol: CRAMP1
  Gene Name: cramped chromatin regulator homolog 1
  Uniprot ID: Q96RY5
  ENST ID: ENST00000293925
  CDS Start-End: 1-3810
atgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagaccccccgggccggcgccgacggcccccccgcgccccccggcgcgccgcaggcgccgtccccgccgcagggcagcccccaggaccagcaccacttcctccggtccagcgtgcggccgcagagcaagaggcccaggaaggatcctccgagcgctgtggggagcggcaacgccggtggctcggggccccgcggaaaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaacccacgcctcaggatgatcgtggagctacatcgaaaggtctccagcctcatcgaattcttgaagcagaagtgggcgctccatgaggtgcgagttcggaagacactcgaggagcggcagctgcaggactcatgctccgcaccgatgcaggagaaggtgacactgcacttgttcccaggcgagaactgtacactgacaccgctgccgggcgtggctcgcgtggtgcactccaaggccttctgcacagtgcactggcaggagggcggccggtgcaagcagagtgccaaggacgcccacgtgctgcccccagcccagatcctgggcatccagagtgggcagggcacggcccggggccaggtgaaatgcccgcggagcggagctgagggcaagggtgtggggcggccccctcctgcggctgacgccttgcagagctccggagagagttcccccgaaagcgcccccggggagggggctgccctaagcttgagcagcccggacgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatct

SEQ ID NO: 122586 - DNA, 7772 bp, Homo sapiens
  Payload ID: 4016
  Gene Symbol: CRAMP1
  Gene Name: cramped chromatin regulator homolog 1
  Uniprot ID: Q96RY5
  ENST ID: ENST00000397412
  CDS Start-End: 100-3909
cgcgcaccccggccccgcccccgcgcgccgtccgtgaggtccccaccggccgccgtagccggaactgctgctgagggcggcgggccggcttcgctagggatgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagaccccccgggccggcgccgacggcccccccgcgccccccggcgcgccgcaggcgccgtccccgccgcagggcagcccccaggaccagcaccacttcctccggtccagcgtgcggccgcagagcaagaggcccaggaaggatcctccgagcgctgtggggagcggcaacgccggtggctcggggccccgcggaaaaggagctgaaggtggtggatcatcgtctggaaatgtgtctggggttgcccctgctgcccctgcagggggctcgcgctcctcctcccggaacttagggtcttctggtggcgagaaggaagaaggcaaaaaggtccggcggcagtgggagtcgtggagcacagaggacaagaacaccttcttcgaggggctgtacgagcatgggaaagactttgaagcgattcagaacaacattgcgctgaagtacaagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaacccacgcctcaggatgatcgtggagctacatcgaaaggtctccagcctcatcgaattcttgaagcagaagtgggcgctccatgaggtgcgagttcggaagacactcgaggagcggcagctgcaggactcatgctccgcaccgatgcaggagaaggtgacactgcacttgttcccaggcgagaactgtacactgacaccgctgccgggcgtggctcgcgtggtgcactccaaggccttctgcacagtgcactggcaggagggcggccggtgcaagcagagtgccaaggacgcccacgtgctgcccccagcccagatcctgggcatccagagtgggcagggcacggcccggggccaggtgaaatgcccgcggagcggagctgagggcaagggtgtggggcggccccctcctgcggctgacgccttgcagagctccggagagagttcccccgaaagcgcccccggggagggggctgccctaagcttgagcagcccggacgctcctgacaggcctcctcccaggcaccaggacactgggccatgtcttgagaagacccctgcagaaggcagggacagtcccacccgggagccaggggccttgccgtgtgcctgtggccagctcccagacctggaggacgagctctcgcttctagaccccttgccccgctacctaaagtcctgtcaggacctcattgtccccgagcagtgccgctgtgcggacacacggcctgggagcgagcagccccctctgggcggggcggcctccccagaggtgctggctcctgtcagcaaggaggctgctgaccttgctcccactggcccatccccgaggcccggccccgggctcctgctggatgtttgcactaaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtcagtacggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccaggcaagagcttccttcttttgtctcacgagtttttcttagagctcttgcctgagctggcttccctccttcagacattgacatgagatcttaagcaaacagtcccaaacctcttaggggtgaaaaaagaaacatgccacttgattaggagagagacagcagtgtttgaactacagcatctttacactagcttgtgttttgtgctacgtataccagcttccaaaattagcatctcattgagccagagaagacaaggagatctccctctgggcatctggctttgctgcgtctctagagggttaggataccaggccgagttcaggccactgctagctttctcatactcccacaggctagaccagagatgccaagtcccaacagcactgagctgtgtgcactgtgccagggacaggagggtttgtgaactgcctgtcagggtacctgttagcccctgacaactcagtggggtgaagttttggaggtcagagtctgctttcgtaggctctttagacagcacctaccacttggttctccagcgtagactcctgggagcagccaactgcagccattgccatccagtggggagatgggttagggaggaggacgggctgactcctctcctgtaataaagctgacaagagttctagaggattctgcttctctagtaactagacaggtgatacgcatttgcttgccacattaagggaaaatggtgtcatttgttgcagaaaaacaatggatacattttcttctggcctaaatgaatatttatgtgcaaacataggcaactgttaaaggctggaattttcaaaagatccaaacagagacttcctgcatcttctgcctttccaacagaagcggtgatcgtctaagtatgagcctgtggcttcctttgtgcatttgagcatgctgtaattaagatgagatcagtttcttagaaaaagctttcctgaatccctctgacgttgcctgggatctttctgttgattcgtcttttctggagattgggacagagcatctgtggtccagggaagttagtcctctggcctcaattctgttgtggatgtgcagtgataagcgggcattgcgtgcctcgggggatgcctagttcgtggcttcctggctgttttgtccttctgtgtcttgtagctgtagggtgccagctcagggagtggggtgttggcggcgtttccgcggttggcctccttgctttgccgcacctccaggttctgggcatgagaggccgtggcctcatttctggtggataacctttttagtttaatagcatctttaattagatcacagcattgaattcaaaatttcttctgcaaagaaagttgtggggcataagacaccgggaatgagggaggaggaagacagttgtgttttctctttaaaccttgagctctagccgatgcatttgtcaggaaatacagcactttgtcttaagaaaacaaggaaggaggccgggcgcagtggctcacgcctgtaatcccagcactttgggaggccgaggcgggcggatcacctgaggtggggagtatgagaccaccctgactaacatggagagaccctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaacttgtaaatgtttttattgtgcataaatacatactaatgttgatctaa

SEQ ID NO: 122587 - DNA, 550 bp, Homo sapiens
  Payload ID: 4016
  Gene Symbol: CRAMP1
  Gene Name: cramped chromatin regulator homolog 1
  ENST ID: ENST00000415022
  CDS Start-End: 1-550
cgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactggtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctcatctgttctctccttatctgagctgcccaaggcccctctccagaatggcctctccataccgctgtcctcgtcagagagctccagcacccggctgtctccaccagacgtctctgctctgctcgacatctccctgcccggccca

SEQ ID NO: 122588 - DNA, 1275 bp, Homo sapiens
  Payload ID: 4017
  Gene Symbol: CFDP1
  Gene Name: craniofacial development protein 1
  Uniprot ID: Q9UEE9
  ENST ID: ENST00000283882
  CDS Start-End: 134-1033
gtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttccttgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatga

SEQ ID NO: 122589 - DNA, 342 bp, Homo sapiens
  Payload ID: 4017
  Gene Symbol: CFDP1
  Gene Name: craniofacial development protein 1
  ENST ID: ENST00000566254
  CDS Start-End: 192-342
gcggtcttgtgagtttgaccagcgtcgagcggcagcaacatggaggaattcgactccgaagacttctctacgtcggaggaggacgaggactacgtgccgtcgggtcttcactgctttggccagtaggagctctttcaggctggatcttgtatccttttaatttgatctttttttattattatttattttttatgagtcggcgtcctgcttactgtagccttcaattcctgggctcaagtgatcctcctgcctcagcctccccagtagatggaactacaggtggagagtatagtgaagatgatgtaaatgaattagtgaaggaagatgaagtggatggtgaag

SEQ ID NO: 122590 - DNA, 454 bp, Homo sapiens
  Payload ID: 4017
  Gene Symbol: CFDP1
  Gene Name: craniofacial development protein 1
  ENST ID: ENST00000569341
  CDS Start-End: 1-60
caggctaatgttccttcagctctgccatcactccctgccgggtcaggatgtgtcatttaaaaaactgttatgacctgctgaattgatttcacaatcaactgcaacctgaatttgacaaaatactgctctagacaacgtatggaattagccttcagcaggtgattaagagttgccaggaagaagaaatttgatgcctagagattgatctgctttttgtttttaagttctagttctggttcgatttcagaaccagtctgcaggcaactctgcattgtctccttagagaactggacaattccactgatctggatcctttggcagcaagctgacattttattgaggctggtcagcactcctggccagagtcttgaaattgtgggtgtgtttttgctgcccattgttgagttattcatgaacagatatgaaaaccatatatatccgaattttgttacca

SEQ ID NO: 122591 - DNA, 395 bp, Homo sapiens
  Payload ID: 4017
  Gene Symbol: CFDP1
  Gene Name: craniofacial development protein 1
  ENST ID: ENST00000612761
  CDS Start-End: 1-52
agctctgccatcactccctgccgggtcagggaagaagaaatttgatgcctagagattgatctgctttttgtttttaagttctagttctggttcgatttcagaaccagtctgcaggcaactctgcattgtctccttagagaactggacaattccactgatctggatcctttggcagcaagctgacattttattgaggctggtcagcactcctggccagagtcttgaaattgtgggtgtgtttttgctgcccattgttgagttattcatgaacagatatgaaaaccatatatatccgaattttgttaccactagatgtgatgagtttttctttttgattatttggggattcttagttctctgtcaaactcttcagattaaaacccttcttatagcta

SEQ ID NO: 122592 - DNA, 2015 bp, Homo sapiens
  Payload ID: 4018
  Gene Symbol: CRP
  Gene Name: C-reactive protein, pentraxin-related
  Uniprot ID: P02741
  ENST ID: ENST00000255030
  CDS Start-End: 105-779
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttga

SEQ ID NO: 122593 - DNA, 667 bp, Homo sapiens
  Payload ID: 4018
  Gene Symbol: CRP
  Gene Name: C-reactive protein, pentraxin-related
  ENST ID: ENST00000368110
  CDS Start-End: 105-413
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcc

SEQ ID NO: 122594 - DNA, 512 bp, Homo sapiens
  Payload ID: 4018
  Gene Symbol: CRP
  Gene Name: C-reactive protein, pentraxin-related
  ENST ID: ENST00000368111
  CDS Start-End: 105-413
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggaccaactacagtcttcccaaggattgagttatggactttgggagtgagacatcttcttgctgctggatttccaagc

SEQ ID NO: 122595 - DNA, 787 bp, Homo sapiens
  Payload ID: 4018
  Gene Symbol: CRP
  Gene Name: C-reactive protein, pentraxin-related
  Uniprot ID: P02741
  ENST ID: ENST00000368112
  CDS Start-End: 105-380
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtggtcctaatgtcctgaactggcgggcactgaagtatgaagtgcaaggcgaagtgttcaccaaaccccagctgtggccctgaggcccagctgtgggtcctgaagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagc

SEQ ID NO: 122596 - DNA, 1063 bp, Homo sapiens
  Payload ID: 4018
  Gene Symbol: CRP
  Gene Name: C-reactive protein, pentraxin-related
  ENST ID: ENST00000437342
  CDS Start-End: 399-539
aaggcaagagatctaggacttctagcccctgaactttcagccgaatacatcttttccaaaggagtgaattcaggcccttgtatcactggcaacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttac

SEQ ID NO: 122597 - DNA, 1709 bp, Homo sapiens
  Payload ID: 4019
  Gene Symbol: CKB
  Gene Name: creatine kinase, brain
  Uniprot ID: P12277
  ENST ID: ENST00000348956
  CDS Start-End: 359-1504
agtttcccgcccagaggcaagggcgtgcgaggggatccagatatccaaggacctgaggtttcggcctcgaggtcttgggcgggggactgggcaggctgcgcggggtcccagcgaggggacagctcgggtgggcggccagggtgttgggggctgcgggcggcggacaaagcggcggcaccaccccgcggcgcgggccaatggaatgaatgggctataaatagccgccaatgggcggcccgcgttgtgccccttaagagccgcgggagcgcggagcggccgctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctg

SEQ ID NO: 122598 - DNA, 1239 bp, Homo sapiens
  Payload ID: 4019
  Gene Symbol: CKB
  Gene Name: creatine kinase, brain
  ENST ID: ENST00000553652
  CDS Start-End: 69-245
cgtcgctccgggagctgccgacggacggagcgcccccgcccccgcccggccgcccgcccgccgccgccatgcccttctccaacagccacaacgcactgaagctgcgcttcccggccgaggacgagccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatact

SEQ ID NO: 122599 - DNA, 542 bp, Homo sapiens
  Payload ID: 4019
  Gene Symbol: CKB
  Gene Name: creatine kinase, brain
  ENST ID: ENST00000553610
  CDS Start-End: 1-540
ttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaag

SEQ ID NO: 122600 - DNA, 523 bp, Homo sapiens
  Payload ID: 4019
  Gene Symbol: CKB
  Gene Name: creatine kinase, brain
  ENST ID: ENST00000557530
  CDS Start-End: 139-523
gctgttcgcctgcgtcgctccgggagctgccgacggacggagcgcccccgcccccgcccggccgcccgccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcg

SEQ ID NO: 122601 - DNA, 625 bp, Homo sapiens
  Payload ID: 4019
  Gene Symbol: CKB
  Gene Name: creatine kinase, brain
  ENST ID: ENST00000554989
  CDS Start-End: 1-61
gtcgcccctgctgctggcctcgggcatggcccgcgactggcccgacgcccgcggtatctgattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgc

SEQ ID NO: 122602 - DNA, 270 bp, Homo sapiens
  Payload ID: 4019
  Gene Symbol: CKB
  Gene Name: creatine kinase, brain
  ENST ID: ENST00000555039
  CDS Start-End: 1-270
ctcctgcgccggtgaccttggccgagcagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctg

SEQ ID NO: 122603 - DNA, 856 bp, Homo sapiens
  Payload ID: 4019
  Gene Symbol: CKB
  Gene Name: creatine kinase, brain
  ENST ID: ENST00000553878
  CDS Start-End: 204-856
gcctggagcgcgcgccggaccggccgggggtccccggcgatgatggcgctccccgcgcgcgctgcggaccccgctgaccttggccgcgtcccggggggcgccggggggcccggcggcgggggcctgagtggtacgcgggagcccgggaaccccggcgtgccggtcccctctgaccccgcgtctccccgcagcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctg

SEQ ID NO: 122604 - DNA, 938 bp, Homo sapiens
  Payload ID: 4020
  Gene Symbol: CKMT1A
  Gene Name: creatine kinase, mitochondrial 1A
  ENST ID: ENST00000457648
  CDS Start-End: 239-448
ggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacacc

SEQ ID NO: 122605 - DNA, 759 bp, Homo sapiens
  Payload ID: 4020
  Gene Symbol: CKMT1A
  Gene Name: creatine kinase, mitochondrial 1A
  ENST ID: ENST00000411750
  CDS Start-End: 316-759
accttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaa

SEQ ID NO: 122606 - DNA, 845 bp, Homo sapiens
  Payload ID: 4020
  Gene Symbol: CKMT1A
  Gene Name: creatine kinase, mitochondrial 1A
  ENST ID: ENST00000415044
  CDS Start-End: 181-845
ctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgt

SEQ ID NO: 122607 - DNA, 1911 bp, Homo sapiens
  Payload ID: 4020
  Gene Symbol: CKMT1A
  Gene Name: creatine kinase, mitochondrial 1A
  Uniprot ID: P12532
  ENST ID: ENST00000413453
  CDS Start-End: 525-1778
ccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgctgca

SEQ ID NO: 122608 - DNA, 1779 bp, Homo sapiens
  Payload ID: 4020
  Gene Symbol: CKMT1A
  Gene Name: creatine kinase, mitochondrial 1A
  Uniprot ID: P12532
  ENST ID: ENST00000434505
  CDS Start-End: 393-1646
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgctgca

SEQ ID NO: 122609 - DNA, 1073 bp, Homo sapiens
  Payload ID: 4020
  Gene Symbol: CKMT1A
  Gene Name: creatine kinase, mitochondrial 1A
  ENST ID: ENST00000626814
  CDS Start-End: 177-1073
agtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttgttgtggggattaagtga

SEQ ID NO: 122610 - DNA, 1779 bp, Homo sapiens
  Payload ID: 4021
  Gene Symbol: CKMT1B
  Gene Name: creatine kinase, mitochondrial 1B
  Uniprot ID: P12532
  ENST ID: ENST00000300283
  CDS Start-End: 393-1646
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 122611 - DNA, 632 bp, Homo sapiens
  Payload ID: 4021
  Gene Symbol: CKMT1B
  Gene Name: creatine kinase, mitochondrial 1B
  ENST ID: ENST00000437924
  CDS Start-End: 246-632
actttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcga

SEQ ID NO: 122612 - DNA, 593 bp, Homo sapiens
  Payload ID: 4021
  Gene Symbol: CKMT1B
  Gene Name: creatine kinase, mitochondrial 1B
  ENST ID: ENST00000417289
  CDS Start-End: 284-593
gtttattccgcggtttccccgcggctgcccccgggagaccgaagaggtggctggggcaggccgaaagcagaggaaaggttgggcagtgtcacccttgcacacccacaggtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaaga

SEQ ID NO: 122613 - DNA, 545 bp, Homo sapiens
  Payload ID: 4021
  Gene Symbol: CKMT1B
  Gene Name: creatine kinase, mitochondrial 1B
  ENST ID: ENST00000428981
  CDS Start-End: 192-368
ttgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtatttgctgacctgtttgaccctgtgatccaagagcgacacaatggatatgacccccggacaatgaagcacaccacggatctagatgccagtaaaagtcagaactggccgaagcatccgaggactcagtctgcctccagcttgcactcgagcagagcgacgagaggtggaacgtgttgtggtggatgcactgagtggcctgaag

SEQ ID NO: 122614 - DNA, 801 bp, Homo sapiens
  Payload ID: 4021
  Gene Symbol: CKMT1B
  Gene Name: creatine kinase, mitochondrial 1B
  ENST ID: ENST00000453733
  CDS Start-End: 193-801
attgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgagga

SEQ ID NO: 122615 - DNA, 1747 bp, Homo sapiens
  Payload ID: 4021
  Gene Symbol: CKMT1B
  Gene Name: creatine kinase, mitochondrial 1B
  Uniprot ID: P12532
  ENST ID: ENST00000441322
  CDS Start-End: 361-1614
agacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 122616 - DNA, 1116 bp, Homo sapiens
  Payload ID: 4021
  Gene Symbol: CKMT1B
  Gene Name: creatine kinase, mitochondrial 1B
  ENST ID: ENST00000453782
  CDS Start-End: 393-1116
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctc

SEQ ID NO: 122617 - DNA, 542 bp, Homo sapiens
  Payload ID: 4021
  Gene Symbol: CKMT1B
  Gene Name: creatine kinase, mitochondrial 1B
  ENST ID: ENST00000449946
  CDS Start-End: 254-542
gtgtttattccgcggtttccccgcggctgcccccgggagaccgaagaggtggctggggcaggccgaaagcagaggaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtc

SEQ ID NO: 122618 - DNA, 2396 bp, Homo sapiens
  Payload ID: 4021
  Gene Symbol: CKMT1B
  Gene Name: creatine kinase, mitochondrial 1B
  ENST ID: ENST00000437534
  CDS Start-End: 193-1089
attgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttgttgtggggattaagtgaaatacaggtaaagtacttggtccacagtaagtgcttaataagtgttaaagtgttagctgcaatattattctggatggaagagtttccccccatgttcagcatgtaagatatcccctatggcatggttccttctgaactataaagaggatccctttactcatgttgggttgtggtctttgtgaccatcattctgctagatcccttgtctcttgaactctaatagtcatcttcatgactacatggttaagtgaagccaaacgccttccccccgccccctattcctatgaatctggcttttctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 122619 - DNA, 1074 bp, Homo sapiens
  Payload ID: 4021
  Gene Symbol: CKMT1B
  Gene Name: creatine kinase, mitochondrial 1B
  ENST ID: ENST00000627381
  CDS Start-End: 178-1074
cagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttgttgtggggattaagtga

SEQ ID NO: 122620 - DNA, 1512 bp, Homo sapiens
  Payload ID: 4022
  Gene Symbol: CKMT2
  Gene Name: creatine kinase, mitochondrial 2 (sarcomeric)
  Uniprot ID: P17540
  ENST ID: ENST00000254035
  CDS Start-End: 114-1373
agggaggatttccaggccggcccgaccagctcgccctgcatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatat

SEQ ID NO: 122621 - DNA, 1637 bp, Homo sapiens
  Payload ID: 4022
  Gene Symbol: CKMT2
  Gene Name: creatine kinase, mitochondrial 2 (sarcomeric)
  Uniprot ID: P17540
  ENST ID: ENST00000424301
  CDS Start-End: 239-1498
atacacttcttggctgtgtgcgctcagcaggacgtgggaggctccggcttcaagatcaaaggaaatgtttccctttgtcccgtttcacactaaacgggttggggaggaaccaggggagatgtcaaccgtctgccggtgactgggaagttttctgcaagtcctccacagcataggccagcaggccacttttcactaacagaagtcacaagccaagtgagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatat

SEQ ID NO: 122622 - DNA, 1479 bp, Homo sapiens
  Payload ID: 4022
  Gene Symbol: CKMT2
  Gene Name: creatine kinase, mitochondrial 2 (sarcomeric)
  Uniprot ID: P17540
  ENST ID: ENST00000437669
  CDS Start-End: 83-1342
ctgcatacacttcttggctgtgtgcgctcagcaggacgtgggaggctccggcttcaaggtcgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaat

SEQ ID NO: 122623 - DNA, 594 bp, Homo sapiens
  Payload ID: 4022
  Gene Symbol: CKMT2
  Gene Name: creatine kinase, mitochondrial 2 (sarcomeric)
  ENST ID: ENST00000511719
  CDS Start-End: 83-594
ctgcatacacttcttggctgtgtgcgctcagcaggacgtgggaggctccggcttcaaggtcgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcat

SEQ ID NO: 122624 - DNA, 546 bp, Homo sapiens
  Payload ID: 4022
  Gene Symbol: CKMT2
  Gene Name: creatine kinase, mitochondrial 2 (sarcomeric)
  ENST ID: ENST00000505060
  CDS Start-End: 74-546
tacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaaggaccactttctgtttgataagccagt

SEQ ID NO: 122625 - DNA, 1657 bp, Homo sapiens
  Payload ID: 4023
  Gene Symbol: CKM
  Gene Name: creatine kinase, muscle
  Uniprot ID: P06732
  ENST ID: ENST00000221476
  CDS Start-End: 176-1321
gctcagctgccctccagaactcctccctggggacaacccctcccagccaatagcacagcctaggtccccctatataaggccacggctgctggcccttcctttgggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccctaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccattgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctt

SEQ ID NO: 122626 - DNA, 10803 bp, Homo sapiens
  Payload ID: 4024
  Gene Symbol: CREBBP
  Gene Name: CREB binding protein
  Uniprot ID: Q92793
  ENST ID: ENST00000262367
  CDS Start-End: 811-8139
ttcttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 122627 - DNA, 7598 bp, Homo sapiens
  Payload ID: 4024
  Gene Symbol: CREBBP
  Gene Name: CREB binding protein
  Uniprot ID: Q92793
  ENST ID: ENST00000382070
  CDS Start-End: 205-7419
ctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgattt

SEQ ID NO: 122628 - DNA, 846 bp, Homo sapiens
  Payload ID: 4024
  Gene Symbol: CREBBP
  Gene Name: CREB binding protein
  ENST ID: ENST00000572134
  CDS Start-End: 1-764
acgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacaggtactgtgccccactgggaccgtggctccctaggaaataaaattcttgtgttaagttttggttttttttttctgtcttccttcgtggaaattaaaattccagaatgcacatttca

SEQ ID NO: 122629 - DNA, 627 bp, Homo sapiens
  Payload ID: 4024
  Gene Symbol: CREBBP
  Gene Name: CREB binding protein
  ENST ID: ENST00000571826
  CDS Start-End: 1-545
atcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacaggtactgtgccccactgggaccgtggctccctaggaaataaaattcttgtgttaagttttggttttttttttctgtcttccttcgtggaaattaaaattccagaatgcacatttca

SEQ ID NO: 122630 - DNA, 718 bp, Homo sapiens
  Payload ID: 4024
  Gene Symbol: CREBBP
  Gene Name: CREB binding protein
  ENST ID: ENST00000573517
  CDS Start-End: 1-590
ataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggtagttttccagctccttccagggcgtgtcattcagtgagccgtgttaggatagaccagggctcttaagtgtcccagaggagcctgtgagccttcataggggattaaagtaaatgaaaccacaattaactaa

SEQ ID NO: 122631 - DNA, 3316 bp, Homo sapiens
  Payload ID: 4024
  Gene Symbol: CREBBP
  Gene Name: CREB binding protein
  ENST ID: ENST00000570939
  CDS Start-End: 1-3316
aatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaatagttcacccaagtatggccttcttgctgacaggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaag

SEQ ID NO: 122632 - DNA, 2501 bp, Homo sapiens
  Payload ID: 4025
  Gene Symbol: CRTC1
  Gene Name: CREB regulated transcription coactivator 1
  Uniprot ID: Q6UUV9
  ENST ID: ENST00000321949
  CDS Start-End: 27-1931
gaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggc

SEQ ID NO: 122633 - DNA, 6929 bp, Homo sapiens
  Payload ID: 4025
  Gene Symbol: CRTC1
  Gene Name: CREB regulated transcription coactivator 1
  Uniprot ID: Q6UUV9
  ENST ID: ENST00000338797
  CDS Start-End: 26-1978
aggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagcccagcggatttctgggggaggccctggcagcggctcctgtctctctgacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcagcgggcgggggcaggcggctcagggcacactcggccgtccctgccccatcctctggcagggctgcttttgtctttgtacctttgcatcctttgtaatgaaacgtaataaaaatccaacgttttcgtca

SEQ ID NO: 122634 - DNA, 2384 bp, Homo sapiens
  Payload ID: 4025
  Gene Symbol: CRTC1
  Gene Name: CREB regulated transcription coactivator 1
  ENST ID: ENST00000594658
  CDS Start-End: 33-1814
cccttaggggaagagtcctgctctggctgttgatgctccagctccagaaatcccagtacctgcaactgggccccagccgaggccagtactatggcgggtccctgcccaacgtgaaccagatcgggagtggcaccatggacctgcccttccagacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggc

SEQ ID NO: 122635 - DNA, 1834 bp, Homo sapiens
  Payload ID: 4025
  Gene Symbol: CRTC1
  Gene Name: CREB regulated transcription coactivator 1
  ENST ID: ENST00000601916
  CDS Start-End: 100-1278
ctccagctccagaaatcccagtacctgcaactgggccccagccgaggccagtactatggcgggtccctgcccaacgtgaaccagatcgggagtggcaccatggacctgcccttccagacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaac

SEQ ID NO: 122636 - DNA, 2290 bp, Homo sapiens
  Payload ID: 4026
  Gene Symbol: CRTC2
  Gene Name: CREB regulated transcription coactivator 2
  ENST ID: ENST00000303569
  CDS Start-End: 119-283
gccgggttcgcggtgctcgctgaggcggcggtggctacggctggaggagccgggccgaggccgcggcggaggccgcggctggtactgggagggtggcagggagggacggggaaggaagatggcgacgtcgggggcgaacgggcctggttcggccacggcctcggcttccaatccgcgcaaatttagtgagaagattgcgctgcagaagcagcgtcaggccgaggagacggcggccttcgaggaggtgatgatggacatcggctccacccgggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaaacccttg

SEQ ID NO: 122637 - DNA, 1635 bp, Homo sapiens
  Payload ID: 4026
  Gene Symbol: CRTC2
  Gene Name: CREB regulated transcription coactivator 2
  ENST ID: ENST00000368630
  CDS Start-End: 80-1201
gctggaggagccgggccgaggccgcggcggaggccgcggctggtactgggagggtggcagggagggacggggaaggaagatggcgacgtcgggggcgaacgggcctggttcggccacggcctcggcttccaatccgcgcaaatttagtgagaagattgcgctgcagaagcagcgtcaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaaa

SEQ ID NO: 122638 - DNA, 2644 bp, Homo sapiens
  Payload ID: 4026
  Gene Symbol: CRTC2
  Gene Name: CREB regulated transcription coactivator 2
  Uniprot ID: Q53ET0
  ENST ID: ENST00000368633
  CDS Start-End: 129-2210
ctaggctggggccgggttcgcggtgctcgctgaggcggcggtggctacggctggaggagccgggccgaggccgcggcggaggccgcggctggtactgggagggtggcagggagggacggggaaggaagatggcgacgtcgggggcgaacgggcctggttcggccacggcctcggcttccaatccgcgcaaatttagtgagaagattgcgctgcagaagcagcgtcaggccgaggagacggcggccttcgaggaggtgatgatggacatcggctccacccggttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaaa

SEQ ID NO: 122639 - DNA, 2343 bp, Homo sapiens
  Payload ID: 4026
  Gene Symbol: CRTC2
  Gene Name: CREB regulated transcription coactivator 2
  ENST ID: ENST00000461638
  CDS Start-End: 1-1446
agccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtctttctctttcaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatcttgctctttgatgacttctgccttgacccgttctcttcctggcatgcacatgctctggcccagcagctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaaa

SEQ ID NO: 122640 - DNA, 2537 bp, Homo sapiens
  Payload ID: 4027
  Gene Symbol: CRTC3
  Gene Name: CREB regulated transcription coactivator 3
  Uniprot ID: Q6UUV7
  ENST ID: ENST00000268184
  CDS Start-End: 5-1864
cgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcagtgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagaagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaa

SEQ ID NO: 122641 - DNA, 5209 bp, Homo sapiens
  Payload ID: 4027
  Gene Symbol: CRTC3
  Gene Name: CREB regulated transcription coactivator 3
  Uniprot ID: Q6UUV7
  ENST ID: ENST00000420329
  CDS Start-End: 148-2004
ctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcagtgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatgaggttgtctctgca

SEQ ID NO: 122642 - DNA, 1421 bp, Homo sapiens
  Payload ID: 4027
  Gene Symbol: CRTC3
  Gene Name: CREB regulated transcription coactivator 3
  ENST ID: ENST00000560098
  CDS Start-End: 105-380
ctggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcagtgcgtcagagtttcaggttgagaggaacagcagtccctgtgttgatggattgaggcagtaactcgaggaggaagattttcctgcacagaactgcagaggcttggggagagagagaacacactgggatgactctgagatcctaacatgagtgtcttggtggacggtggcctcactaaatgagatggactataagaagaggaacagattaaggggacagtgattggttggatttttggtagaatttgagctgtcttgggtacttttggcagagaacttgagtaggcagttggaagtatgcacttggagttcacaaaagaactgttgggagctggaggtgtcgatttatgagttactggactgtgggtgacagtggggccgagggaaggatgcgattggccaaggcgagcatggaggacaggggctctctaccaggaagacgggcactggccctgaggctcttaggaagcgcctcctaaagctcctgtgcccggaggctcccgccaccccctccacctgctcacactctgcctggtgcccagggatcctgagagcatcctttgcctctcagagcaatgcaggcaggtgtggcctgaggctgcgaggccacaggaccccagggaacatcaggacggaaggcaaaggggcggaaaggagtgcacagagggataagaaaagatccatgtgagtgtggggatttttttttttaactttaatttttgtttccatccattgcagccacctcttctttgtttatctttttcatcatccctcctccctgccttccttttttaatgtggaaatcttccttgagccaaaggcttcactaagcttaactaaggaagcaatggaggaggcgctgatgtggttgttaaaagccctgtgacctgtgctgcccttccgctggcacgctggcacctggcagggatgccagaaatgtttcttgagtaaatggtaaattcaagtttataaataagagtgtttcctttgtctcgaggttgttacttagggcatgtcagtgttgtggagtagtttaaagccacctgaatgaagttttctgaagttttccaaagaacaaataaacttcttctagattttccttgca

SEQ ID NO: 122643 - DNA, 570 bp, Homo sapiens
  Payload ID: 4027
  Gene Symbol: CRTC3
  Gene Name: CREB regulated transcription coactivator 3
  ENST ID: ENST00000558005
  CDS Start-End: 1-570
ccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatggtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatag

SEQ ID NO: 122644 - DNA, 1431 bp, Homo sapiens
  Payload ID: 4028
  Gene Symbol: CREBZF
  Gene Name: CREB/ATF bZIP transcription factor
  ENST ID: ENST00000260058
  CDS Start-End: 1-855
gtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaattttcttttttaggtgatttccttcctgccaggctccgttgtaggggttacagaacagtcgttcccgcctcacaacctgtggatacagctgttggggcagaagagacgggaccagctgctggccacatttcctgctttattttaaaagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatg

SEQ ID NO: 122645 - DNA, 898 bp, Homo sapiens
  Payload ID: 4028
  Gene Symbol: CREBZF
  Gene Name: CREB/ATF bZIP transcription factor
  ENST ID: ENST00000527529
  CDS Start-End: 1-391
gatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaattttcttttttaggtgatttccttcctgccaggctccgttgtaggggttacagaacagtcgttcccgcctcacaacctgtggatacagctgttggggcagaagagacgggaccagctgctggccacatttcctgctttattttaaaagttatgggctcaaagaatttattcatctctaacatgatattggaaaataatggatgaaaataggaaaaatgattgttaatgctgactgtgggtcttaaaaggttctggaaagcacttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttt

SEQ ID NO: 122646 - DNA, 4037 bp, Homo sapiens
  Payload ID: 4028
  Gene Symbol: CREBZF
  Gene Name: CREB/ATF bZIP transcription factor
  Uniprot ID: Q9NS37
  ENST ID: ENST00000527447
  CDS Start-End: 228-1292
ggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctggtaaggatccatctcttcccgtaacgctcatgctctgctgctttgtctactttaatgggcaacatctcagtttgtgtgtgtgtgatttttttttttttttctgttttggaaggtgggagggaaatctaatttgggccctgtccaccctggaaacagacttgtgctggtcaagaatgtatttaagatgcctcttctggttgaaatagctattaatgtgtccccttattcagacttgcgtgtacctagctcttctgtccccagtgtggacatggccttggatgacatcggttccaactgtacactgaaacctgcttatagagagacagtttggagacagtgaaacaggtgaagttgaatggaagttccgagttgtacaaggtgcaaattggaattccgattttagggcaacttttcagaggttgacagttaagtatttggggcatgcacaaatgtgatagttattttgctggaggtgacaggtatctcttaaatatcaacaatgccttttagttttcagtatgagatatagaaacagtctataatggagtaacattttaatgtctcaccattagagaagttggaaattaacatacatatgagactcctgcgttttagttaattggagaataagaatggctaatgtttctttgaggaccagcagtgattaccctatcactgagattgaataaattgttgaacatctttatttttgttgtattaaaattttaggttaaatttatatatgtatgattagatattgaaggttgtgaaatgtgaatgaaaacgtgtaaagtgaggcttcacaaagaatcttattctctgtgtttcaaaagtatttgtcctattttaaaataattttttaaattgagtggttctggccacttaaatgacacgattggtactattttcctaaggtgggatttattcccttgaatctattaaccagttgtataaattgaattatggtgtccttcagtgtaagaggcattaagaaattctttgtgaaacatcactgcttgataaagtatatacgtatttagcatccttgtttttctttgtgctaaagtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaa

SEQ ID NO: 122647 - DNA, 4329 bp, Homo sapiens
  Payload ID: 4028
  Gene Symbol: CREBZF
  Gene Name: CREB/ATF bZIP transcription factor
  Uniprot ID: Q9NS37
  ENST ID: ENST00000490820
  CDS Start-End: 228-1292
ggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaa

SEQ ID NO: 122648 - DNA, 2850 bp, Homo sapiens
  Payload ID: 4028
  Gene Symbol: CREBZF
  Gene Name: CREB/ATF bZIP transcription factor
  ENST ID: ENST00000525639
  CDS Start-End: 228-1304
ggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaattttcttttttaggtgatttccttcctgccaggctccgttgtaggggttacagaacagtcgttcccgcctcacaacctgtggatacagctgttggggcagaagagacgggaccagctgctggccacatttcctgctttattttaaaagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttt

SEQ ID NO: 122649 - DNA, 545 bp, Homo sapiens
  Payload ID: 4028
  Gene Symbol: CREBZF
  Gene Name: CREB/ATF bZIP transcription factor
  ENST ID: ENST00000534224
  CDS Start-End: 1-204
atgcgtgccgaccctccagcctctctaccgctcctcctccctcccacaaccttttcttttttaggtgatttccttcctgccaggctccgttgtaggggttacagaacagtcgttcccgcctcacaacctgtggatacagctgttggggcagaagagacgggaccagctgctggccacatttcctgctttattttaaaagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaag

SEQ ID NO: 122650 - DNA, 7778 bp, Homo sapiens
  Payload ID: 4029
  Gene Symbol: CREBRF
  Gene Name: CREB3 regulatory factor
  Uniprot ID: Q8IUR6
  ENST ID: ENST00000296953
  CDS Start-End: 320-2239
gagtcacgcgatttccgggaacccgtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccagagcttgtcggttaaagaagaaagcccagtatgaagctaataaagtgaaattatggggcctcaacacagaatatgataatttattgtttgtaatcaactccatcaagcaagagattgtaaaccgggtacagaatccaagagatgagagaggacccaacatggggcagaagcttgaaatcctcattaaagatactctcggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaa

SEQ ID NO: 122651 - DNA, 1660 bp, Homo sapiens
  Payload ID: 4029
  Gene Symbol: CREBRF
  Gene Name: CREB3 regulatory factor
  Uniprot ID: Q8IUR6
  ENST ID: ENST00000520420
  CDS Start-End: 304-1557
gggaacccgtcaggaaggacataaacaaaacaaacccgaggcagcatggagaggggccgtggcccctgcagcggaaccggacccagtccctgagccgcccctacacccacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattgg

SEQ ID NO: 122652 - DNA, 559 bp, Homo sapiens
  Payload ID: 4029
  Gene Symbol: CREBRF
  Gene Name: CREB3 regulatory factor
  ENST ID: ENST00000523161
  CDS Start-End: 482-559
gaaggcgagtccgatcggaccaggaagtagctcaggggagcctgacctcgacccgcctttctcctcacacgagctgaggaggcagggaagtaccgagggcagtcaagcctcccctgggggtggttcctgggactagatggagctcagtctctggattctccctctttctcggccctatgcttcctgacagacctggccgccaaaccctgtaatcgccctcctttaacccaagaaagcaagtctttctgccgtttctgagctggcttgagccttaagactaccttaaggagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaact

SEQ ID NO: 122653 - DNA, 2466 bp, Homo sapiens
  Payload ID: 4029
  Gene Symbol: CREBRF
  Gene Name: CREB3 regulatory factor
  Uniprot ID: Q8IUR6
  ENST ID: ENST00000522692
  CDS Start-End: 316-1569
gagtcacgcgatttccgggaacccgtcaggaaggacataaacaaaacaaacccgaggcagcatggagaggggccgtggcccctgcagcggaaccggacccagtccctgagccgcccctacacccacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaactctgatgagcacagatctcttagcaaacagttcggatccagatttcatgtatgaactggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattggatatgtaattggtttttctattcaaatagctctaaaatgatcacttttgctcacatagggattcataagctgattccttgagggcttattttttattattttatttcttatttttaaaattaaaatagagatgagagcttgccactgtgcccagctgaggacttattcttaatgtatcttatgttaagtgacctgttttgtcactctcttgagcatttatgcaaagacaccaataatttattggtttaaaaaatattcctgtttagggccaggcgcagtggctcacgttagtaatcccagcactttgggaggccgaggtgggcggatcacctgaggtcaggagttaaagaccagcccggccaacacagcgaaaccctgtctctactaaaaatacaaaaatcagatgtggtggcacgcatctgtaatcccagctactccagaggttgaggcgggagaatcacttgaacccaggaggctgaggttgcggttagctgacatcgcaccattgcactccagcctgggcaacaggagtgaaagtctgtctcaataacaacaaaaaataataaataaaaatattactgtttatgcatgtgtctctctattatagttgagataagttaggagtatatagaatgttgaaccaagtgatgatggtttatattactcattccaatacccaacaaagtctatttatgaataatgtaaaagcattttctttgtgtctgctaacattttaatttacatcgtattttcctatttaagaaaaatacatgctgtaatttggtgagcatgaa

SEQ ID NO: 122654 - DNA, 1046 bp, Homo sapiens
  Payload ID: 4030
  Gene Symbol: CFC1
  Gene Name: cripto, FRL-1, cryptic family 1
  Uniprot ID: P0CG37
  ENST ID: ENST00000259216
  CDS Start-End: 264-935
atagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagat

SEQ ID NO: 122655 - DNA, 1554 bp, Homo sapiens
  Payload ID: 4030
  Gene Symbol: CFC1
  Gene Name: cripto, FRL-1, cryptic family 1
  ENST ID: ENST00000615342
  CDS Start-End: 289-864
agtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagaggtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccactgtgaccggtaggtagagacagcagaacaacagcgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagagggcacttgcattgagctcttcagctttttaaatccactgtagttcatgagcctgtgtgacataattacttttacattttatattgtcaattagtttattggcattttcaatcttttcaactattggctatgaaaatatgaatttaacgtaacattcaaatgagtattaaagaaaaataaagtagaacttcatt

SEQ ID NO: 122656 - DNA, 1444 bp, Homo sapiens
  Payload ID: 4030
  Gene Symbol: CFC1
  Gene Name: cripto, FRL-1, cryptic family 1
  ENST ID: ENST00000621673
  CDS Start-End: 289-735
agtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagaggacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccactgtgaccggtaggtagagacagcagaacaacagcgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagagggcacttgcattgagctcttcagctttttaaatccactgtagttcatgagcctgtgtgacataattacttttacattttatattgtcaattagtttattggcattttcaatcttttcaactattggctatgaaaatatgaatttaacgtaacattcaaatgagtattaaagaaaaataaagtagaacttcatt

SEQ ID NO: 122657 - DNA, 1071 bp, Homo sapiens
  Payload ID: 4031
  Gene Symbol: CFC1B
  Gene Name: cripto, FRL-1, cryptic family 1B
  Uniprot ID: P0CG36
  ENST ID: ENST00000281882
  CDS Start-End: 289-960
agtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagat

SEQ ID NO: 122658 - DNA, 1444 bp, Homo sapiens
  Payload ID: 4031
  Gene Symbol: CFC1B
  Gene Name: cripto, FRL-1, cryptic family 1B
  ENST ID: ENST00000620207
  CDS Start-End: 289-735
agtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagaggacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccactgtgaccggtaggtagagacagcagaacaacagcgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagaaggcacttgcattgagctcttcagctttttaaatccactgtagttcatgagcctgtgtgacacaattacttttacattttatattgtcaattagtttattggcattttcaatcttttcaactattggctatgaaaatatgaatttaacgtaacattcaaatgagtattaaagaaaaataaagtagaacttcatt

SEQ ID NO: 122659 - DNA, 1554 bp, Homo sapiens
  Payload ID: 4031
  Gene Symbol: CFC1B
  Gene Name: cripto, FRL-1, cryptic family 1B
  ENST ID: ENST00000619050
  CDS Start-End: 289-864
agtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagaggtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccactgtgaccggtaggtagagacagcagaacaacagcgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagaaggcacttgcattgagctcttcagctttttaaatccactgtagttcatgagcctgtgtgacacaattacttttacattttatattgtcaattagtttattggcattttcaatcttttcaactattggctatgaaaatatgaatttaacgtaacattcaaatgagtattaaagaaaaataaagtagaacttcatt

SEQ ID NO: 122660 - DNA, 4370 bp, Homo sapiens
  Payload ID: 4032
  Gene Symbol: CRNKL1
  Gene Name: crooked neck pre-mRNA splicing factor 1
  ENST ID: ENST00000377327
  CDS Start-End: 33-2543
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaa

SEQ ID NO: 122661 - DNA, 4406 bp, Homo sapiens
  Payload ID: 4032
  Gene Symbol: CRNKL1
  Gene Name: crooked neck pre-mRNA splicing factor 1
  Uniprot ID: Q9BZJ0
  ENST ID: ENST00000377340
  CDS Start-End: 33-2579
ctttccgacactctttgggaagagaatctctaatgacggcaacagtggagaacctaacgttccagaaggacactttgggaaatgctgttgacaaaaacacatccagattggagctccgttcttactcccttgcagggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaa

SEQ ID NO: 122662 - DNA, 4093 bp, Homo sapiens
  Payload ID: 4032
  Gene Symbol: CRNKL1
  Gene Name: crooked neck pre-mRNA splicing factor 1
  Uniprot ID: Q9BZJ0
  ENST ID: ENST00000496549
  CDS Start-End: 33-257
ctttccgacactctttgggaagagaatctctaatgacggcaacagtggagaacctaacgttccagaaggacactttgggaaatgctgttgacaaaaacatccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaa

SEQ ID NO: 122663 - DNA, 4183 bp, Homo sapiens
  Payload ID: 4032
  Gene Symbol: CRNKL1
  Gene Name: crooked neck pre-mRNA splicing factor 1
  ENST ID: ENST00000490910
  CDS Start-End: 33-347
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaa

SEQ ID NO: 122664 - DNA, 4009 bp, Homo sapiens
  Payload ID: 4032
  Gene Symbol: CRNKL1
  Gene Name: crooked neck pre-mRNA splicing factor 1
  Uniprot ID: Q9BZJ0
  ENST ID: ENST00000536226
  CDS Start-End: 125-2188
agttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaa

SEQ ID NO: 122665 - DNA, 9023 bp, Homo sapiens
  Payload ID: 4033
  Gene Symbol: CRB1
  Gene Name: crumbs family member 1, photoreceptor morphogenesis associated
  ENST ID: ENST00000367397
  CDS Start-End: 859-2883
gcgagaaagaggtgacattgaagaacaagcccacacttctggatatggtccaaaatgatcagaaactcactctgtcaacctagtaggtgtttggatggatacctcttttttaacagaaagatgtttggagccaggacacatggttttcacattttaatggcaatgctcataggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgagtcacattagagccttctggaagagaattctgagctaaagaatgatgggattactcaaagttcattttctcctctaattttttatctcagttcccataggaaaatctatgctgaaatagaggttcagacagaatgaaacaataaaaaagaagaaaaactacagtttaggtcaaaggggagaacattttattagacaaaacttcaaatagggaaaaatgatttttaaaaaatgtataatgtgctatttttctttcttataagtacttctgaattcatgtctcttttttgttgctaactctaatacatgatgcaaatatggttgctgtcgaggtaaaataaattacaactaaaagattgcctcatagaattgcctacaacccaaaagtatatataccttatccatatgagtctacttttcccagagaaactcttcaactgttcttcacctcatacaggaattcttaaaatggagttggtcaatggcttcaggcaatctgtgacctgctgaaaatacaggaaaattagaatatgtatttgagtggctaggggtaagttcaggggtagaaataatgcatactgaatagcttttatcagctgcttaaagggatttatgtccccaaaacagttatgaactggggctctatagaatacagatactatataagcagataattgttaaccttttgttttagcactgtgccatgcaccttacaaataccatctctaattcttatagctctgtaaagaaggtttcatgatttttattttgcatatgtgtaaactgaggctgagaggttgagtgacgtataaagggcctatccacacgtttgctgcagtaaggttgagctgccttcaaagcctctgctcttctatttgatgtgccagcataactgtatgaataaatctttgctcaacacaatttctttttttttaatgagaaaggtgttcttccatctcatgtatcatcgagggtaagataagtgatctctgatcaaacttcctacattgaaaaaattaaataaactgagctcagacatatttgacaaagatattttgactgactcaatatttcccataagcatagttaataaaataatggatatgtgagtgctccctggcaagtgccctttggattaattggaattttctgttttctagctggcctcttttgcatcacaaagacacaggtcttttgccatttttacaaaacagcggggagtctagggtatacctgaatttgacccttttaacgttcattttcatttgcagcctgccttctgtggttggttctttgtggtacaggcattccaagtctatatgtgcatgaaaggagatagccttgagtcacattctgctttctgttgcaccaattttggttctgcaacttattaactgagatcgtttagttgtattccaattccatgtatctttcaaaatattgcaaatattttcttgtcattaattttgagtaatccaactattgtcaagggtgggttgcttcctggttgaacgtcacactttctgcctaatggcacaatgcatggaactcatccaaaaccctggattatttttctctgccactcacacattgtttctatttacaacaaatatctccctgtcttctgatatttattagtttacaaaatttatatttgacatttaaattcagatatatttgaaatatagaaagaaaagaaagcttagagttttccttcttttcccaggagacttttcaactggaaaaacttacatgatgctagatatttctaaaacattgaacctgtgttcagtagattctatgctttcaaagtccttaaccatcattacttaattgactagatgttaatggatttatttttacttttcatgcattaattaacctctaataaaaatgccaatgatgctgataatacatgtgtatctattgttgactgtttagttcaacagagaaataggtgagaaagtgatggagtagttagaggaagacagaaaatagtgggctatctcccatggcctagggaaatgtgacttccatcacatccaaggatattgaaaagctatcctcaaataaattggcttctctcctgccttggttaaaccttcagcttaatagtgtcatcctggcaggttttgaatgatggatggtgtgaacactctggcccacccaagaccgagaatgcttggcaggctcctgagggttgtcaagttttgctcagatctaatcagagaagtctccctccagtccagaagcataagccaaaaaaggaaaacaaaatgtctcagctatgcttggtatccaaagggataaggagctgtttttcttggaagaaatctttgttttcctttataccttgggctggccttgccccactacctcaccccctttcattttgagcctagtgattagtctctgacccatacgtgcaagttttacattttggaaggtgagggaaagaataagggaaaattaaaaattgtttacatacaatttcaacattataagctgcactatagagatcttggagctaagattttatataaattttcaaaagtaaaatagccgccttagttgctgttctatcccaaggtcttagcagagtgtttgtcacatagtatgtgttaaataaatatccactgtgtgactgaatacatgattggtgacttaatccatgaatatacagaaaaacaaattcttgctggaaaattagtttaaaaaaatgacaatatcccaggaagaagaaaacttcaatttacctgagacttgatgtcacttgtcttggaaaatttggcttttgaaagtcattctacctcaacatttcagaaattatgcttggctattggaacacagatttattagcaagtacaatcttctaattattgatttttgcttttgttataaaaaaaggatttccacagaaaataattcaaaatctctcagaataaacctctcctcttcctcctcctcctccttccctccttcttttttttttttttttttttttttggtttctctttggtgggctttttccttagcctgagggctctgatgcatgaggatcctgatagcctgaatgtaggtctgccctgcagactccagatggcaaaatacagcctctctccttgtgcccctaataaactgaacatttatataaggtggcaaccacactaatgctcttgagcattgacactggtgtaggcatggcccacttttctcttggtttctaaatatttgcatctattttctcattctaattaattccgtgtgtatatgtatatatatgtgtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtacaaacatattatcattctcaacacttctatatgtgaatgaccactgcaatttcttcccactccatttctgggtattttcacattttaagttgccctccatcactatgattctattttcatttctgttctttcattcttatctattatttatgacacaaaaattgagaattacaggccaggtgtggtggttcactcctataatcccagcactatgggaggctgaagtgggcggaacacctgaggccaggagtttgagaccagcctagccaacgtggtgaaaacctgtctctactaaaaatacaaaagtaactgggagtggtggcacatgcctgtaatcccagctactcaggagggtgaagcaggagacttgcttgaacccaggaggcggccgttgcaatgagccaagattgtgccactgcactccagcctgggcgacaggtgagattctgtctaaaaaaaaaaaaaaaaaaagagagaattaccgattaaaattactgattatattcatctatgtttttacatgaagctattcaaatgaattgttacgttttctctgatatatgattaaatatataaagagaaatcaggaatttacatcgagtccctaaattgtagaaaaacaattatctagtatcagtactcaaattatacctccctggtataatttctgattccataaaactgtctctctaacaaagttacaaataatcctttctctatttcctttcctgcaatactttcccttttcctaacaaatagaacaatttttctgttgtttctaaatttatgagctccttgacttttctatcaaatggactaatttcagttgcttttcaatgaatatttaataaaaataagcactgtagtttatacataaatttaaaagtatatattgtaaaacttgaattttcttagaagcatggttttctaagatttgcaagtaaatttattttcttaagtatctttcagaaaaaaatatgaaagcatagtatacatcataaccaaaatatatttgacattatgattttttaaaataaatgtatacctgaaataatggatctataaagtatactaagatatgcaaaaattaatatattctttattataaatatttcagagattataaaataataatttaaaaaaactttcttaatgtttttattgtttccaccagtacgttatcatttatgctaaatatctttgtgtagatatacccttccaaagaagacgttatttgtgttcatttaaaggaaaaatagtttgatcctatgaattaattcagaaagcaactaaaataacaatggcctgccaaatgtcattttgtaaatatacgtctatgactttaggagctgtcctggtttgaaaacatgaggacagtttatccattggatgccatctatttagtcccaattaagaaagttgtttttttgtgagaatgaccaaggtaaatttaaatataccattcaaacaaacaaggacaaaataatatccttgttatagagtacatgtagcatatagtatgaagtaatatactacaaaagcaaagaaagtgtattctatcttgcaatagtaatagacaatttttatatagcaaattcatatcctttggagtagtgacaatcatttcaaactgggagcaactaattgtgaagattttccttcttactcatccattttcttcacatccaaggctgaacgtgtgatgctgctgcttcagatgatttgttccaaagttaaattttgtgacaaaagacatggggaaaaccttcccatcaatatttacattcacaagtatttgcaataagcataaaatagattatagccagaccatatgtatagttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctg

SEQ ID NO: 122666 - DNA, 3885 bp, Homo sapiens
  Payload ID: 4033
  Gene Symbol: CRB1
  Gene Name: crumbs family member 1, photoreceptor morphogenesis associated
  Uniprot ID: P82279
  ENST ID: ENST00000367399
  CDS Start-End: 1-3885
atggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttag

SEQ ID NO: 122667 - DNA, 4932 bp, Homo sapiens
  Payload ID: 4033
  Gene Symbol: CRB1
  Gene Name: crumbs family member 1, photoreceptor morphogenesis associated
  Uniprot ID: P82279
  ENST ID: ENST00000367400
  CDS Start-End: 136-4356
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 122668 - DNA, 1031 bp, Homo sapiens
  Payload ID: 4033
  Gene Symbol: CRB1
  Gene Name: crumbs family member 1, photoreceptor morphogenesis associated
  ENST ID: ENST00000448952
  CDS Start-End: 1-129
gaaaaggacattgatgagtgtgcctctgatccgtgtgtcaatggaggtctgtgccaggacttactcaacaaattccagtgcctctgtgatgttgcctttgctggcgagcgctgcgaggtggactactgagtggtaccagcttgctctggttggtcttcattcctgagtagttccattgtcctgaatatttatttgcctttgctatagaattcgcatcccaatgatttcaatctttccagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 122669 - DNA, 5174 bp, Homo sapiens
  Payload ID: 4033
  Gene Symbol: CRB1
  Gene Name: crumbs family member 1, photoreceptor morphogenesis associated
  Uniprot ID: P82279
  ENST ID: ENST00000484075
  CDS Start-End: 136-4266
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 122670 - DNA, 3397 bp, Homo sapiens
  Payload ID: 4033
  Gene Symbol: CRB1
  Gene Name: crumbs family member 1, photoreceptor morphogenesis associated
  Uniprot ID: P82279
  ENST ID: ENST00000538660
  CDS Start-End: 210-2822
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgc

SEQ ID NO: 122671 - DNA, 5140 bp, Homo sapiens
  Payload ID: 4033
  Gene Symbol: CRB1
  Gene Name: crumbs family member 1, photoreceptor morphogenesis associated
  ENST ID: ENST00000535699
  CDS Start-End: 417-4565
cctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagaggcagaccaatgtgggaagggcactcactgagttgggatccagaggacctaagtaccaagtttcactgtttcgcttctgtgtaggatcttgggcaactggaaacaccttctttttatcatctataaaaccaggatccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgc

SEQ ID NO: 122672 - DNA, 3659 bp, Homo sapiens
  Payload ID: 4034
  Gene Symbol: CRB2
  Gene Name: crumbs family member 2
  Uniprot ID: Q5IJ48
  ENST ID: ENST00000359999
  CDS Start-End: 92-3622
agtgctggttggagggacgaggggggtgcggagccagccaggccgccctcccgttctcacagcagccgagcagagcgcagagcgggctgccatggcgctggccaggcctgggaccccggacccccaggccctggcctctgtcctgctactgctgctctgggcccctgccctttccctcctggctgggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggtgggatggctgggcaggggggtgggctgcgaatgccccctggggctatggtggggcagagaagtctgccaggtctgtggatgagtcgcttcccttccctggtcctcatgtccttatctgtgacatgaggaggacagtttaatttgataaatttcctgataaaatacagatcaaaacac

SEQ ID NO: 122673 - DNA, 5550 bp, Homo sapiens
  Payload ID: 4034
  Gene Symbol: CRB2
  Gene Name: crumbs family member 2
  Uniprot ID: Q5IJ48
  ENST ID: ENST00000373631
  CDS Start-End: 2-3859
catggcgctggccaggcctgggaccccggacccccaggccctggcctctgtcctgctactgctgctctgggcccctgccctttccctcctggctgggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggttgcctgtcccatccaaggagtgcagcctgaatgtcacctgcctcgatggcagcccatgtgagggtggctctcccgctgccaactgcagctgcctggagggtcttgctggccagaggtgtcaggtccccactctcccctgtgaagccaacccctgcttgaatgggggcacctgccgggcagctggaggggtgtctgaatgtatctgcaatgccagattctccggccagttctgtgaagtggcgaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctaggccagcctggctgctggcaccagcacctggaggtcctgaatggtttctacctggagacccaaggaagctgcttccagggctcgggacattgctacggaagtgtccccttggctggcagcctctgcctctgcctctgccccatcctggatggaggacgaggggagcaactcagggaaacagaggcctagagaggctgcggacttctccatcccaccctcggggttccgccttggcaggtgtacggctgtgcgtgggagggcacacgtgggttcacagtgtgttcaggagtgtgtgtatctggaggagtgtgtgtgtgagtgtgtacctgggcctgtgttagtctgcagatgctagtgtgagtgtgtcctgacatggctccagggcgtgtctgccgtgtttactgtgtgtctatgactgtgatgggtgtagctgatcccaggaggtggcggctgcgccatggggtcaaccattacagtcctagggcaggggcggcccaaggctgcatgttctccaggaggccaggccggggttgcccaggcacctccttccccgcctctgggggctgctcctgctgtggaggcagctgggaagtcagggaaggccactagcagaggctgagtgggcttctggctcctagaacaaatgtcccttcaggcaggtctgtctgccagaagccagagccagtcatgcgagggaaccacagacccacccgccccctcagccggagcagcccgagggagcagaggaggggctgcctggagcttcccaccctgctgtggtcatttgtcaaagggggaaggcacccactgcctacctcacagggctgttgtgaggatcagagaggacgacagtggggaaagaatctggaagtcttcaactgccgtctgatgggaaggaccgtctgggtgtccttctgggatgaggatgacagagcaacccttctcctgccctgaacccccccagctcacctgaccacctctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtcggggctgggcctgcagaggccgactcagaggagactctgctgcttgctcccagccccttccccggcgatgcccatcacactgtgacctcccatccctgaagggcacctgcctgagggcctggcctccttccagcttcatggacctggagatgtgccctttcatccttcctgcttcccaggccagtagatccgtttacacttttgggtcgacagtcagcttttccttttggttttggcgggtcccagaggcatgggtgtccagtccaatgtggggagccacgtgacaacgtgggggactgggacatgggactgggaagtcagcagacgctgggatagagagggccctgaacaccaggctcaggggcttgcttggtccttatcctgtaggaggtgggaccacctttccctgaactttctctacaacccttgggagcgtggggaggaggcggctggttccagggtcagtttactaagttagagatttggaaaacctgtgtcagctgtaactcctaggatattttatgtggaacctaacatgcagatgaaagctg

SEQ ID NO: 122674 - DNA, 3947 bp, Homo sapiens
  Payload ID: 4034
  Gene Symbol: CRB2
  Gene Name: crumbs family member 2
  Uniprot ID: Q5IJ48
  ENST ID: ENST00000460253
  CDS Start-End: 111-2972
attcctgagcaggctccgaaggaggcagctgggccaggcagggagctctgcctcctccccacttccccagcctcagtgcccgcccaccactctcaacctgtctggagggcatggcaatggagccgggggctctgtggaccttcctgggccacctgtggctcctggcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggttgcctgtcccatccaaggagtgcagcctgaatgtcacctgcctcgatggcagcccatgtgagggtggctctcccgctgccaactgcagctgcctggagggtcttgctggccagaggtgtcaggtccccactctcccctgtgaagccaacccctgcttgaatgggggcacctgccgggcagctggaggggtgtctgaatgtatctgcaatgccagattctccggccagttctgtgaagtggcgaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctaggccagcctggctgctggcaccagcacctggaggtcctgaatggtttctacctggagacccaaggaagctgcttccagggctcgggacattgctacggaagtgtccccttggctggcagcctctgcctctgcctctgccccatcctggatggaggacgaggggagcaactcagggaaacagaggcctagagaggctgcggacttctccatcccaccctcggggttccgccttggcaggtgtacggctgtgcgtgggagggcacacgtgggttcacagtgtgttcaggagtgtgtgtatctggaggagtgtgtgtgtgagtgtgtacctgggcctgtgttagtctgcagatgctagtgtgagtgtgtcctgacatggctccagggcgtgtctgccgtgtttactgtgtgtctatgactgtgatgggtgtagctgatcccaggaggtggcggctgcgccatggggtcaaccattacagtcctagggcaggggcggcccaaggctgcatgttctccaggaggccaggccggggttgcccaggcacctccttccccgcctctgggggctgctcctgctgtggaggcagctgggaagtcagggaaggccactagcagagcccattcctgagccagacaggtcacggttgacccaggaagagccatgtgccaggatggccgccaagcctcactgagcatgtgcagcagtggcagcctctcagacatagagggggctccctgggtgacatctccagagacccccttgtcccccagacacccctgggtagactgtgtctgacccttcacaaataggaaatgagagctcgggtcgaaatgctcacaatttcctgcgtgtctcagatggttgttttcttaaatggtcgggccatactttaacttggtttatggaaatgaatccatttcaagattcatcaaatcaataaggtaaaaaggaaaaagaaagataataaacattcaatct

SEQ ID NO: 122675 - DNA, 631 bp, Homo sapiens
  Payload ID: 4035
  Gene Symbol: CRB3
  Gene Name: crumbs family member 3
  Uniprot ID: Q9BUF7
  ENST ID: ENST00000308243
  CDS Start-End: 172-534
gttgtctctcctgtgggcctgcgccggggtccccaccccgatcccaacgcctgggcctctccttctcctgtccccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctgaacgctggggcctgctgcagccaccaacactgcccaggactgcgggttgctggcttgtacaccgcagctgccaccgagacaccagcctctgatggctc

SEQ ID NO: 122676 - DNA, 733 bp, Homo sapiens
  Payload ID: 4035
  Gene Symbol: CRB3
  Gene Name: crumbs family member 3
  Uniprot ID: Q9BUF7
  ENST ID: ENST00000356762
  CDS Start-End: 163-534
acggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaa

SEQ ID NO: 122677 - DNA, 1443 bp, Homo sapiens
  Payload ID: 4035
  Gene Symbol: CRB3
  Gene Name: crumbs family member 3
  Uniprot ID: Q9BUF7
  ENST ID: ENST00000598494
  CDS Start-End: 532-894
ttatttatttatttattttttgtagagaatgaggcctcgctgtgttgcccaggctggtctcggactcctggcctcaagcaatcctcttgcctcggcctctcaaagtgttgggattacaggcgtgagccattgcgcctgggcaggtattttttctcattaagcgctccccatccaagtctgccctaggcaggagtgcctagtgcacgggtacatacataccccgtgcgtctccacacctgtgcgctcccacagatatgctcgcaatgcaggtgtaaggtccccctcacacctgcgcgcttccgcggtctccctccccgcatccccattaagggactggggtcccgttacaggtgcgcccacagcgcggccccgcccccttcttgactccgccctctcagcgaggctcaggtgcacaagccggaagtgcgctctcccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctgaacgctggggcctgctgcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctgcttgcggaaccaacttttctctgtgtgtccagcaggccccacaaccccctctcctttctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaa

SEQ ID NO: 122678 - DNA, 1078 bp, Homo sapiens
  Payload ID: 4035
  Gene Symbol: CRB3
  Gene Name: crumbs family member 3
  Uniprot ID: Q9BUF7
  ENST ID: ENST00000600229
  CDS Start-End: 167-529
accgacggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctgaacgctggggcctgctgcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctgcttgcggaaccaacttttctctgtgtgtccagcaggccccacaaccccctctcctttctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaa

SEQ ID NO: 122679 - DNA, 3267 bp, Homo sapiens
  Payload ID: 4036
  Gene Symbol: CRY1
  Gene Name: cryptochrome circadian clock 1
  Uniprot ID: Q16526
  ENST ID: ENST00000008527
  CDS Start-End: 869-2629
ggggcctgtggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcggctcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggtggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaa

SEQ ID NO: 122680 - DNA, 621 bp, Homo sapiens
  Payload ID: 4036
  Gene Symbol: CRY1
  Gene Name: cryptochrome circadian clock 1
  ENST ID: ENST00000549356
  CDS Start-End: 1-321
atcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattaggtaaatattttagagctgtatttcttgctttagaagagtatataattaacataaattaagataatttcaaaaatggagcaaatctctattttcaaaccagaaaatcttgaggcattaatttttaagcaatttttacaaactcagttaatttttggtcaagagacatgcatctgtactggagaaattgttgcaccagttttatattcatctgaaccaatgctctttaaattagagatgtttatgattttgtggtcaagttttttcttagaaaaagacaacttttttatttccttactatgt

SEQ ID NO: 122681 - DNA, 2053 bp, Homo sapiens
  Payload ID: 4037
  Gene Symbol: CRY2
  Gene Name: cryptochrome circadian clock 2
  Uniprot ID: Q49AN0
  ENST ID: ENST00000417225
  CDS Start-End: 133-1731
agcttcttctagaagcaggccctgaacaggacgtgggtaagagatccgctgtcccttgagacttggcctactcccggcactccgcggacagccccagcctgcggacagccccagcctgcgtcacttgtccgcatgccagctccacccgggcggacccacacatggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctg

SEQ ID NO: 122682 - DNA, 4203 bp, Homo sapiens
  Payload ID: 4037
  Gene Symbol: CRY2
  Gene Name: cryptochrome circadian clock 2
  ENST ID: ENST00000443527
  CDS Start-End: 23-1867
gtcataggtcactgggcgggctatgggcggggtccacgtcgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagaacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgtcagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagta

SEQ ID NO: 122683 - DNA, 4204 bp, Homo sapiens
  Payload ID: 4037
  Gene Symbol: CRY2
  Gene Name: cryptochrome circadian clock 2
  ENST ID: ENST00000616623
  CDS Start-End: 23-1867
gtcataggtcactgggcgggctatgggcggggtccacgtcgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagaacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgtcagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagtaa

SEQ ID NO: 122684 - DNA, 1936 bp, Homo sapiens
  Payload ID: 4037
  Gene Symbol: CRY2
  Gene Name: cryptochrome circadian clock 2
  Uniprot ID: Q49AN0
  ENST ID: ENST00000616080
  CDS Start-End: 17-1798
agcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagagg

SEQ ID NO: 122685 - DNA, 1139 bp, Homo sapiens
  Payload ID: 4038
  Gene Symbol: CRYAA
  Gene Name: crystallin, alpha A
  Uniprot ID: P02489
  ENST ID: ENST00000291554
  CDS Start-End: 93-614
agggagggctcggccttggctccacactgcgctgcccagaggccccgctgactcctgccagcctccaggtccccgtggtaccaaagctgaacatggacgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaa

SEQ ID NO: 122686 - DNA, 826 bp, Homo sapiens
  Payload ID: 4038
  Gene Symbol: CRYAA
  Gene Name: crystallin, alpha A
  ENST ID: ENST00000398132
  CDS Start-End: 177-587
ctaacggaccaaccaacccgtaacgacccctcctaccataaccagtagccagccagcccataaccagccaacttatctataaccagccacctgaccatagccaaacaaccagccggcccaccagtagcattcagcccctcagctggccctgagggtttggagacaggtcgagggtcatgcctgtctgtccaggagacagtcacaggcccccgaaagctctgccccacttggtgtgtgggagaagaggccggcaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccc

SEQ ID NO: 122687 - DNA, 600 bp, Homo sapiens
  Payload ID: 4038
  Gene Symbol: CRYAA
  Gene Name: crystallin, alpha A
  ENST ID: ENST00000398133
  CDS Start-End: 125-586
gcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggctagcaaagctcttggcaagtttacttaggtgccctgccaaggctaaaaggacaggcaatggacgcccccccccccacccaaccacaggcctcctctctgagccacgggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctc

SEQ ID NO: 122688 - DNA, 848 bp, Homo sapiens
  Payload ID: 4039
  Gene Symbol: CRYAB
  Gene Name: crystallin, alpha B
  Uniprot ID: P02511
  ENST ID: ENST00000227251
  CDS Start-End: 186-713
gccattgggtgtggacagaaagctagtgaaacaagaccatgacaagtcactggccggctcagacgtgtttgtgtctctcttttcttagctcaaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagc

SEQ ID NO: 122689 - DNA, 695 bp, Homo sapiens
  Payload ID: 4039
  Gene Symbol: CRYAB
  Gene Name: crystallin, alpha B
  ENST ID: ENST00000529647
  CDS Start-End: 307-695
agaaatgcctggaacttgccctcactgagcctaagctcggaggcccctgccctgctgccctccccagctggggcggcccgaggccggacatagtagccatggtagagtctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccc

SEQ ID NO: 122690 - DNA, 624 bp, Homo sapiens
  Payload ID: 4039
  Gene Symbol: CRYAB
  Gene Name: crystallin, alpha B
  ENST ID: ENST00000528628
  CDS Start-End: 393-624
ataccttctccgaagcgctgctcacccaggcggctcgggttggcaaattcgtactcggcggtggccgggtgggcatgtggcactgagcggcccgacatggctgcagatgcagcagaagccctggtccgaggtgcagccccaacaggcgcagcgcgacccctccagctgcccggagagccagggctcgataggagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtca

SEQ ID NO: 122691 - DNA, 464 bp, Homo sapiens
  Payload ID: 4039
  Gene Symbol: CRYAB
  Gene Name: crystallin, alpha B
  ENST ID: ENST00000524660
  CDS Start-End: 1-319
aggcccagccaacattgatctaaacctttgggaaatacccctaaacatatctatgcctcagggtttgaaaaacaatgaagtgttggactgtttcagacttctcagattctcactggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataac

SEQ ID NO: 122692 - DNA, 1119 bp, Homo sapiens
  Payload ID: 4039
  Gene Symbol: CRYAB
  Gene Name: crystallin, alpha B
  Uniprot ID: P02511
  ENST ID: ENST00000533475
  CDS Start-End: 451-978
ggcgcagggagcagggagatgtagacctcattgacctctgtgtccaaatgtcggccaccccgaggtgcttccaggtttaagatgccatcatgggagagagcagctcggactcgccaggggtcgacatcagcaggcaggacataggtgcggcagaactctcgggacacgaagccgtggcggtccaggcgctgggggtgccgggcagacacctccagcaggttatccacagtcctcacagtcacctcgtctgggctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 122693 - DNA, 1013 bp, Homo sapiens
  Payload ID: 4039
  Gene Symbol: CRYAB
  Gene Name: crystallin, alpha B
  Uniprot ID: P02511
  ENST ID: ENST00000531198
  CDS Start-End: 368-895
aaacggcctgggtggatagaagggggacaaggaggcacacccaggccggcaaagagcaggtatcagcactgcaagcaccaagtgtgtcttgagggggtggggtctttctgcccagatgtgggatcctctcctaaacccaggtcaacccagggcacgaggcagatggctgctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagcta

SEQ ID NO: 122694 - DNA, 981 bp, Homo sapiens
  Payload ID: 4039
  Gene Symbol: CRYAB
  Gene Name: crystallin, alpha B
  ENST ID: ENST00000533971
  CDS Start-End: 93-560
agcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggtatgtagcttgtttttttgttttctgctcattcattcagtgcatactgtaatagtccaggtagtgctatcagctttggaggctggctacattccagtcccaagccataacagtcgggatcaggggttacaaatcaatgtctagaagactaagttaggatagacatattgctgttgttactattatggccagagatgtggcctttgatttgatcgccttagatgggatgatgggatgctgatgccccatttaagccagtggttctgaatctgggccacattagaatcaccaggggaactttcaaaaaacctaatgctcgggcatactccagaccaattagcatatgtgctgccgaagcgagcactactccagaccaattaaatcagcatttttaagggtgggacccaggcatcagcaatttttaaggtaattctaatctacagtcaaggttgagaaccactgattaggtatagggctgtcagacacctagttgctttgcataattacattaactacaggtaccctaaaagcacttgagttgtgacttctcttttagctgtgcaag

SEQ ID NO: 122695 - DNA, 517 bp, Homo sapiens
  Payload ID: 4039
  Gene Symbol: CRYAB
  Gene Name: crystallin, alpha B
  ENST ID: ENST00000526167
  CDS Start-End: 198-517
gggtggaaaactggcaaagagacctgagccagaagaagaggcctttgtctcacagacaaaccacaaagccaggcattggagtcagagaggcagcagatgccaggcttgcacccatccttgcgactggtcccctgggtgatctgtcttcttctctgtccctgtaaataaagtttgggtctgatcaccatgagccttagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaa

SEQ ID NO: 122696 - DNA, 545 bp, Homo sapiens
  Payload ID: 4039
  Gene Symbol: CRYAB
  Gene Name: crystallin, alpha B
  ENST ID: ENST00000533280
  CDS Start-End: 75-401
gaggcagcagatgccaggcttgcacccatccttgcgactggtcccctgggtgatctgtcttcttctctgtccctatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataa

SEQ ID NO: 122697 - DNA, 915 bp, Homo sapiens
  Payload ID: 4039
  Gene Symbol: CRYAB
  Gene Name: crystallin, alpha B
  ENST ID: ENST00000525823
  CDS Start-End: 445-771
ggagctgagtgggcaagggctttggaaggacaagcaggaccagcagaacattccagattgggtgggtggaaaactggcaaagagacctgagccagaagaagaggcctttgtctcacagacaaaccacaaagccaggcattggagtcagagaggcagcagatgccaggcttgcacccatccttgcgactggtcccctgggtgatctgtcttcttctctgtccctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataa

SEQ ID NO: 122698 - DNA, 479 bp, Homo sapiens
  Payload ID: 4039
  Gene Symbol: CRYAB
  Gene Name: crystallin, alpha B
  ENST ID: ENST00000533879
  CDS Start-End: 274-479
aggaggaggaggcaccaaacggcctgggtggatagaagggggacaaggaggcacacccaggccggcaaagagcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcg

SEQ ID NO: 122699 - DNA, 353 bp, Homo sapiens
  Payload ID: 4039
  Gene Symbol: CRYAB
  Gene Name: crystallin, alpha B
  ENST ID: ENST00000528961
  CDS Start-End: 29-353
gcaggaccagcagaacattccagattggatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaat

SEQ ID NO: 122700 - DNA, 1017 bp, Homo sapiens
  Payload ID: 4039
  Gene Symbol: CRYAB
  Gene Name: crystallin, alpha B
  Uniprot ID: P02511
  ENST ID: ENST00000526180
  CDS Start-End: 291-818
gggtgccattgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataactgtcttgtgtttgaatattccacacacttttaaataaatatacagataccacag

SEQ ID NO: 122701 - DNA, 965 bp, Homo sapiens
  Payload ID: 4039
  Gene Symbol: CRYAB
  Gene Name: crystallin, alpha B
  ENST ID: ENST00000527899
  CDS Start-End: 442-965
agcaagaggggagtcaggaggagtagggaacgggagggaggccacactgtagctaggaggagaaggcagctcggaagaggggaaagagaacggaaaggaaagggaggaggaggaggagaaggaggaggagggggaggaggaggaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaa

SEQ ID NO: 122702 - DNA, 887 bp, Homo sapiens
  Payload ID: 4039
  Gene Symbol: CRYAB
  Gene Name: crystallin, alpha B
  Uniprot ID: P02511
  ENST ID: ENST00000527950
  CDS Start-End: 219-746
aacagggagcactgaatttgctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 122703 - DNA, 977 bp, Homo sapiens
  Payload ID: 4039
  Gene Symbol: CRYAB
  Gene Name: crystallin, alpha B
  Uniprot ID: P02511
  ENST ID: ENST00000616970
  CDS Start-End: 308-835
aggaggaggaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagat

SEQ ID NO: 122704 - DNA, 783 bp, Homo sapiens
  Payload ID: 4040
  Gene Symbol: CRYBA1
  Gene Name: crystallin, beta A1
  Uniprot ID: P05813
  ENST ID: ENST00000225387
  CDS Start-End: 2-649
gatggagacccaggctgagcagcaggagctggaaacccttccaaccaccaagatggctcagaccaaccctacgccggggtccctggggccatggaagataaccatctatgatcaggagaactttcagggcaagaggatggagttcaccagctcctgtccaaatgtctctgagcgcagttttgataatgtccggtccctgaaggtggaaagtggcgcctggattggttatgagcataccagcttctgtgggcaacagtttatcctggagagaggagaataccctcgctgggatgcctggagtgggagtaatgcctaccacattgagcgtctcatgtccttccgccccatctgttcagctaatcataaggagtctaagatgaccatctttgagaaggaaaactttattggacgccagtgggagatctctgacgactacccctccttgcaagccatgggctggttcaacaacgaagtcggctccatgaagatacaaagtggggcctgggtttgctaccaatatcctggatatcgtgggtatcagtatatcttggaatgtgaccatcatggaggagactataaacattggagagagtggggctctcatgcccagacttcgcagatccaatcgattcgccgaatccaacagtagctgattaaaagctccaagtacgataattcctcaagcatgagaccttgctaagcactctagaataagttttatgttctgctcacagacattgctttcaaatgttagctgctgaaatccacaataaacgtcattta

SEQ ID NO: 122705 - DNA, 641 bp, Homo sapiens
  Payload ID: 4040
  Gene Symbol: CRYBA1
  Gene Name: crystallin, beta A1
  ENST ID: ENST00000484605
  CDS Start-End: 1-227
aggctgagcagcaggagctggaaacccttccaaccaccaagatggctcagaccaaccctacgccggggtccctggggccatggaagataaccatctatgatcaggagaactttcagggcaagaggatggagttcaccagctcctgtccaaatgtctctgagcgcagttttgataatgtccggtccctgaaggtggaaagtggcgcaatcataaggagtctaagatgaccatctttgagaaggaaaactttattggacgccagtgggagatctctgacgactacccctccttgcaagccatgggctggttcaacaacgaagtcggctccatgaagatacaaagtggggcctgggtttgctaccaatatcctggatatcgtgggtatcagtatatcttggaatgtgaccatcatggaggagactataaacattggagagagtggggctctcatgcccagacttcgcagatccaatcgattcgccgaatccaacagtagctgattaaaagctccaagtacgataattcctcaagcatgagaccttgctaagcactctagaataagttttatgttctgctcacagacattgctttcaaatgttagctgctgaaatccacaataaacgtcatttaaaaaaaaaaaa

SEQ ID NO: 122706 - DNA, 893 bp, Homo sapiens
  Payload ID: 4041
  Gene Symbol: CRYBA2
  Gene Name: crystallin, beta A2
  Uniprot ID: P53672
  ENST ID: ENST00000295728
  CDS Start-End: 238-831
gccggtccatttccctcgcgtgccgcgctcacccacccggtgaatgccctctgctggggtggggaagggaggggagcgcgggaagactgcgagcccctggcagccgggtccagagctaggccgggtccagcccccgggttcttcatccgctacccaggttgggcaggctgtgtgtggctcgaaacggggctcttgagacgctgagcgcgtggtgccacccttcctgtccgcagcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 122707 - DNA, 708 bp, Homo sapiens
  Payload ID: 4041
  Gene Symbol: CRYBA2
  Gene Name: crystallin, beta A2
  Uniprot ID: P53672
  ENST ID: ENST00000392096
  CDS Start-End: 52-645
gcctcgcagccggtccatttccctcgcgtgccgcgctcacccacccgcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgccc

SEQ ID NO: 122708 - DNA, 493 bp, Homo sapiens
  Payload ID: 4041
  Gene Symbol: CRYBA2
  Gene Name: crystallin, beta A2
  ENST ID: ENST00000453769
  CDS Start-End: 108-493
ccctcgcgtgccgcgctcacccacccggttgggcaggctgtgtgtggctcgaaacggggctcttgagacgctgagcgcgtggtgccacccttcctgtccgcagcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatc

SEQ ID NO: 122709 - DNA, 811 bp, Homo sapiens
  Payload ID: 4042
  Gene Symbol: CRYBA4
  Gene Name: crystallin, beta A4
  Uniprot ID: P53673
  ENST ID: ENST00000354760
  CDS Start-End: 36-626
acatgttccctgggcctatctcggaaggggccacaatgaccctgcaatgcacaaagtcagcgggaccctggaagatggtggtgtgggatgaggacggcttccagggccggcggcacgagttcacggccgagtgccccagcgtgctggagcttggcttcgagactgtgcgatctttgaaagtgctgagtggagcgtgggtgggctttgagcatgctggcttccaagggcagcagtacattctggaacgaggcgaatatccaagctgggatgcctggggcggcaacacggcctaccccgccgagaggctcacctccttccggcctgcggcctgtgctaaccaccgtgactcgaggctgacaatcttcgagcaagagaacttcctgggcaagaaaggagagctgagcgatgactatccttccctccaggccatgggatgggaaggcaatgaagtagggtccttccacgtccactctggggcctgggtttgctcccagtttccgggctaccgaggatttcagtatgtgctggaatgcgatcaccattccggtgactacaaacatttccgggagtggggctctcatgccccgaccttccaggtgcagagcatccgcaggatccagcagtgaacaggggtgcggcacggaggagcgcatgcgtgcttatctgcaatggaggcgctctggaggctgtggtgtgttctctccttctgcctccccctgtaacctgtgtgaacccagcacccatgtgaactggtccgtgcacagtcagcacaaaaaactcaaacgaataaaaaagagaaagtctggtatta

SEQ ID NO: 122710 - DNA, 1102 bp, Homo sapiens
  Payload ID: 4043
  Gene Symbol: CRYBB1
  Gene Name: crystallin, beta B1
  Uniprot ID: P53674
  ENST ID: ENST00000215939
  CDS Start-End: 132-890
acagactatagggcctgatgtctgccagactataaaatggggggtcggactctagtcacccatagcacctgcccgcctgcctgtcctccagcaggaagtagcaagtccccagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacaggctggtggtcttcgaactggaaaacttccagggccgtcgagcagaattctcgggggagtgctcaaatctggcagaccgtggcttcgaccgtgtgcgcagcatcattgtctccgcgggaccctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactgaaaagtt

SEQ ID NO: 122711 - DNA, 886 bp, Homo sapiens
  Payload ID: 4044
  Gene Symbol: CRYBB2
  Gene Name: crystallin, beta B2
  Uniprot ID: P43320
  ENST ID: ENST00000398215
  CDS Start-End: 172-789
ggtgagagcttaatccagcattctcaccctgcttttcgcaggagcacagcggtcactcatcttggcaccggcacttctggggaaggtataaatgccacctcccgctggccgagcttcacggcactcgcaggggctggtgtcactggtcattcctgcacaggacagtccaccatggcctcagatcaccagacccaggcgggcaagccacagtccctcaaccccaagatcatcatctttgagcaggaaaactttcaaggccactcgcatgagctcaatgggccctgccccaacctgaaggaaactggcgtggagaaggcaggttctgtcctagtgcaggctggaccctgggtgggctatgaacaggccaactgcaagggcgagcagtttgtgtttgagaagggtgagtacccccgctgggactcatggaccagcagccgaaggacggactccctcagctccctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgcgggtgcagagtggcacgtgggttggctaccagtaccccggctaccgtgggctgcagtacctgctggagaagggagactacaaggacagcagcgactttggggcccctcacccccaggtgcagtccgtgcgccgtatccgcgacatgcagtggcaccaacgtggtgccttccacccctccaactagtgccctccccaccatgcctccttcccaggacccaggtctgctgcccaggaaccctccagacctcccagagagtgaataaagtgtgacttgcaacttg

SEQ ID NO: 122712 - DNA, 867 bp, Homo sapiens
  Payload ID: 4045
  Gene Symbol: CRYBB3
  Gene Name: crystallin, beta B3
  Uniprot ID: P26998
  ENST ID: ENST00000215855
  CDS Start-End: 81-716
agacaggcgagtctgcagacggccgtggctcctctgttcttcccgaggctacagcaacagccagaggtgttcctggggagatggcggaacagcacggagcacccgaacaggctgcagctggcaagagccatggagaccttgggggcagctacaaggtgatcttgtacgaactagagaacttccaaggcaaacgctgcgagctctcggccgagtgccccagcctgaccgacagcctgctggagaaggtgggctccatccaagtggagtccgggccgtggctggcatttgagtccagggccttccgcggggagcagtttgttctggagaagggggattatcctcgctgggatgcctggtccaacagccgtgatagtgacagccttctgtccctccggcctctgaatattgatagtccacatcacaagctgcatctgtttgagaacccagctttcagtggccgcaagatggagatagtggatgatgacgtgcccagcctgtgggctcatggcttccaggaccgtgtggcgagtgtccgtgccatcaacgggacgtgggttggctatgagttccccggctaccgtgggcgccagtacgtgtttgagcggggcgagtaccgccactggaatgagtgggacgccagccagccgcagctgcagtctgtgcgccgcatccgtgaccagaagtggcacaagcggggccgcttccccagcagctgaaaggcacccagacttcaaggacccagacccaccctggggggctgcaagggcaagaagaggaggctccagggttggggcgagggccgacctgtccacccttccctggaatctgctcaataaagcctggggttggtcccccacccgccacgtt

SEQ ID NO: 122713 - DNA, 601 bp, Homo sapiens
  Payload ID: 4045
  Gene Symbol: CRYBB3
  Gene Name: crystallin, beta B3
  ENST ID: ENST00000404334
  CDS Start-End: 54-395
cgtggctcctctgttcttcccgaggctacagcaacagaggtgttcctggggagatggcggaacagcacggagcacccgaacaggctgcagctggcaagagccatggagaccttgggggcagctacaaggtgatcttgtacgaactagagaacttccaaggcaaacgctgcgagctctcggccgagtgccccagcctgaccgacagcctgctggagaaggtgggctccatccaagtggagtccgggccgtggctggcatttgagtccagggccttccgcggggagcagtttgttctggagaagggggattatcctcgctgggatgcctggtccaacagccgtgatagtgacagccttctgtccctccggcctctgaatattgtgggttggctatgagttccccggctaccgtgggcgccagtacgtgtttgagcggggcgagtaccgccactggaatgagtgggacgccagccagccgcagctgcagtctgtgcgccgcatccgtgaccagaagtggcacaagcggggccgcttccccagcagctgaaaggcacccagacttcaaggacccagacccaccctggggggctgcaagggcaaga

SEQ ID NO: 122714 - DNA, 609 bp, Homo sapiens
  Payload ID: 4046
  Gene Symbol: CRYGA
  Gene Name: crystallin, gamma A
  Uniprot ID: P11844
  ENST ID: ENST00000304502
  CDS Start-End: 21-545
atcaccctctgtcaacaaccatggggaagatcaccttctacgaggaccgagactttcagggtcgctgctacaattgcatcagtgactgccccaacctgcgggtctacttcagccgctgcaactccatccgagtagacagcggctgctggatgctctatgagcgtcccaattaccagggccaccagtacttcctgcgccgaggcaagtaccccgactatcagcactggatgggcctcagcgactcggtccaatcctgccgtataattcctcataccagctcgcacaagttaaggctgtacgagagagatgactaccgaggccttatgtctgagctcactgatgactgcgcctgtgttccagaactgttccgtctccctgagatctattccctccacgtactggagggctgctgggtcctctatgaaatgcccaactaccgggggcggcagtatctgctgaggcctggggactacagaaggtaccacgactgggggggtgcagatgccaaagtcggctctttgagacgggtcaccgatttgtactaagctgtgcctgccttgttgtgatccccatagaaacataataaatatacaagttgtgttccctgca

SEQ ID NO: 122715 - DNA, 641 bp, Homo sapiens
  Payload ID: 4047
  Gene Symbol: CRYGB
  Gene Name: crystallin, gamma B
  Uniprot ID: P07316
  ENST ID: ENST00000260988
  CDS Start-End: 49-576
ccgcagtcccacacagcaaccagaaaacatctgctcacttccttcaaaatgggaaagatcaccttctacgaggacagggccttccagggccgcagctacgaatgcaccactgactgccccaacctacaaccctatttcagccgctgcaactccatcagggtggagagcggctgctggatgatctatgagcgccccaactaccagggccaccagtacttcctgcggcgtggggagtaccctgactaccagcaatggatgggcctcagcgactccatccgctcctgctgcctcatccccccgcactctggcgcttacagaatgaagatctacgacagagatgaattgaggggacaaatgtcagagctcacagacgactgtatctctgttcaggaccgcttccacctcactgaaattcactccctcaatgtgctggagggcagctggatcctctatgagatgcccaactacagggggaggcagtatctgctgaggccgggggagtacaggaggtttcttgattggggggctccaaatgccaaagttggctctcttagacgagtcatggatttgtactgaagtatttacgttttccacttttctcctttaaaatctaataaaatatttagcttgtgtttctggca

SEQ ID NO: 122716 - DNA, 629 bp, Homo sapiens
  Payload ID: 4048
  Gene Symbol: CRYGC
  Gene Name: crystallin, gamma C
  Uniprot ID: P07315
  ENST ID: ENST00000282141
  CDS Start-End: 39-563
ccatcacactgaactcgcatcatccgtgtcaaccagccatggggaagatcaccttctatgaggacagggccttccagggccgcagctacgaaaccaccactgactgccccaacctgcagccgtatttcagccgctgcaactccatccgggtggagagcggctgctggatgctctatgagcgtcccaactaccaaggtcaacaatacttgctgcggcgaggggagtaccccgactaccagcaatggatgggcctcagcgactccatccgctcctgttgtctcatcccccaaacagtctcccacaggctgcggctgtacgagagggaagaccacaaaggcctcatgatggagctgagtgaagactgccccagcatccaggaccgcttccacctcagcgagatccgttccctccacgtgctggagggctgctgggtcctctacgagctgcccaactaccgggggcggcaatacctgctgaggccccaagagtacaggcggtgccaggactggggggccatggatgctaaggcaggctctttgcggagagtggtggatttgtattaaaatagcttaacactaccaatttcccattttggaacctaataaatatttagtctgcattgctggcaa

SEQ ID NO: 122717 - DNA, 619 bp, Homo sapiens
  Payload ID: 4049
  Gene Symbol: CRYGD
  Gene Name: crystallin, gamma D
  Uniprot ID: P07320
  ENST ID: ENST00000264376
  CDS Start-End: 29-553
ctcagcaccgccgtgcgcccagccagccatggggaagatcaccctctacgaggaccggggcttccagggccgccactatgaatgcagcagcgaccaccccaacctgcagccctacttgagccgctgcaactcggcgcgcgtggacagcggctgctggatgctctatgagcagcccaactactcgggcctccagtacttcctgcgccgcggcgactatgccgaccaccagcagtggatgggcctcagcgactcggtccgctcctgccgcctcatcccccactctggctctcacaggatcagactctatgagagagaggactacagaggccagatgatagagttcactgaggactgctcctgtcttcaggaccgcttccgcttcaatgaaatccactccctcaacgtgctggagggctcctgggtcctctacgagctgtccaactaccgaggacggcagtacctgctgatgccaggggactataggcgctaccaggactggggggccacgaatgccagagtgggctctctgaggagagtcatagatttctcctgaaatatgtcctcttttgttgtttcttaatttggaaactaataaaatattttctgtgtgttcctggca

SEQ ID NO: 122718 - DNA, 754 bp, Homo sapiens
  Payload ID: 4050
  Gene Symbol: CRYGN
  Gene Name: crystallin, gamma N
  Uniprot ID: Q8WXF5
  ENST ID: ENST00000337323
  CDS Start-End: 128-676
ggcttagcacgcccgacagcactaacgctccggggccggcccagcaaatcttttgtccggggcggcgctgagccagcagggcgctgcccggtgtaaacggggacccgcggaaggggcggggcgcaccatggcgcagcgctcggggaagatcactctctatgaaggcaagcacttcacagggcagaagctggaggtcttcggggactgtgacaacttccaggaccggggctttatgaaccgagtgaactccatccacgtggagagcggagcctgggtctgcttcaatcaccccgacttccggggccagcagttcatcttggagcacggcgactaccccgacttcttccgctggaacagccacagtgaccacatgggctcctgtcggcctgtaggaatgcacggagaacatttccgcctagaaatcttcgagggttgcaacttcacgggccagtgcctggagttcctggaggacagccccttcctccagagcaggggctgggtcaagaactgtgtgaacaccatcaaggtgtacggggacggagcagcatggagccctagaagcttcggagctgaggacttccagctgagcagctctcttcaatcagatcaaggaccggaagaggccaccacaaaaccagcaacaacccagccacctttcctgactgcaaacctctgagcctggaaccgattgacatgtaaatgcacctgcaccgtttctgagccgggagagtgtttacttaaaatcatgccctca

SEQ ID NO: 122719 - DNA, 698 bp, Homo sapiens
  Payload ID: 4050
  Gene Symbol: CRYGN
  Gene Name: crystallin, gamma N
  Uniprot ID: Q8WXF5
  ENST ID: ENST00000491928
  CDS Start-End: 92-469
cggcccagcaaatcttttgtccggggcggcgctgagccagcagggcgctgcccggtgtaaacggggacccgcggaaggggcggggcgcaccatggcgcagcgctcggggaagatcactctctatgaaggcaagcacttcacagggcagaagctggaggtcttcggggactgtgacaacttccaggaccggggctttatgaaccgagtgaactccatccacgtggagagcggagcctgggtctgcttcaatcaccccgacttccggggccagcagttcatcttggagcacggcgactaccccgacttcttccgctggaacagccacagtgaccacatgggctcctgtcggcctgtaggaatggtgagtgggcccgtccaccgaaggctgagtcttcctgctggagggaccgagggtcagccctggcagacagtggcaaggaatcggggagcgtggtcctcccggctttaaagtctgtaagactgaaggagctatacccagagccacctgctggcatgagagcatggagccctagaagcttcggagctgaggacttccagctgagcagctctcttcaatcagatcaaggaccggaagaggccaccacaaaaccagcaacaacccagccacctttcctgactgcaaacctctgagcctggaaccgattgacatgtaaatgcacctgcaccgtttctgagcc

SEQ ID NO: 122720 - DNA, 759 bp, Homo sapiens
  Payload ID: 4051
  Gene Symbol: CRYGS
  Gene Name: crystallin, gamma S
  Uniprot ID: P22914
  ENST ID: ENST00000307944
  CDS Start-End: 126-662
ctattctcatgactaagcaaatgtttgactgaaaccagcccatataaatgtcactgtgcctctaactctctgtagccattcctgaatttctttcagcactgggaaaaccagtctatgcaccaaaaatgtctaaaactggaaccaagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatccca

SEQ ID NO: 122721 - DNA, 1132 bp, Homo sapiens
  Payload ID: 4051
  Gene Symbol: CRYGS
  Gene Name: crystallin, gamma S
  Uniprot ID: P22914
  ENST ID: ENST00000392499
  CDS Start-End: 341-877
cccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcgtctttgtgatgcccaaatgaaaaagttggtgaagcactgggaaaaccagtctatgcaccaaaaatgtctaaaactggaaccaagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatcccactgctgactataatgcctctccttaaatgcttctagggaccagcaatacagtgctcgccacagtgggcagtcacacaaagctacccatctgccagatcaccaatctagatctttgtgccaaacaaaatgagatctcattaaaaggttagaaagtcata

SEQ ID NO: 122722 - DNA, 1485 bp, Homo sapiens
  Payload ID: 4052
  Gene Symbol: CRYL1
  Gene Name: crystallin, lambda 1
  Uniprot ID: Q9Y2S2
  ENST ID: ENST00000298248
  CDS Start-End: 64-1023
agagctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaca

SEQ ID NO: 122723 - DNA, 1581 bp, Homo sapiens
  Payload ID: 4052
  Gene Symbol: CRYL1
  Gene Name: crystallin, lambda 1
  Uniprot ID: Q9Y2S2
  ENST ID: ENST00000382812
  CDS Start-End: 230-1123
agagctcgcagctccgccggcgcctggtcccagcgcccgcggcgccgcgtccccggcccaaccatggcgtcctccgcggccggctgcgtggtgatcgttggcagaattaaaactctgtacccattgaacaacagctgctcatttcccccagccccagcccctggcatccacccttctagctttctgtctctatgggtacctcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaa

SEQ ID NO: 122724 - DNA, 1035 bp, Homo sapiens
  Payload ID: 4052
  Gene Symbol: CRYL1
  Gene Name: crystallin, lambda 1
  ENST ID: ENST00000480748
  CDS Start-End: 1-445
gcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggagttggcttcagttttgggatgaagcagccctgtggtcttggaaatgccagatggacatgtctggccacaatctactgacacttacttcccctgccggaggcgtgctccctgggtcacgtgatcttattggctgggatgtcatttcaagtctacatttttaaggcattagcataatgaaggacattgtgttgtgacaatagacttttggctggacagtagctaagtttgttgcctgtaaattctttcccatgagggcagggtatgtggaggtgcctgggaatgaatctgcaaccctcggcaggttctcagcctgctggtgtgagttggtggtgatgagcttcggaaattgctgaccttgggttctgcctgtccttcggaatgatgtcatccctgtgctggactgctgtccttagggcctgggccgcagagattgagttcttggtctcttgatttgtcagggtgggtgtggtctggggcatctggatggggccctgagattccagaacttcatcgttgagctttacttcagacatgtctgccaactgttaggagacattgttttagttaatgaagtgtatctcaaagatcatgtagtaaaattgacagatgagg

SEQ ID NO: 122725 - DNA, 1471 bp, Homo sapiens
  Payload ID: 4053
  Gene Symbol: CRYM
  Gene Name: crystallin, mu
  Uniprot ID: Q14894
  ENST ID: ENST00000219599
  CDS Start-End: 267-1211
cttgtctgccactatgtgagatatacctttcaccttctgccgtgattgtgaggcctcctcagccacgtggaactgtaaaaactcctggaagaaaagatcctgcaatttggctttttgtgagatggaaaagattacaccttgccctgcaaacttcccccctttaaaggcgaaggtttgttagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgca

SEQ ID NO: 122726 - DNA, 1400 bp, Homo sapiens
  Payload ID: 4053
  Gene Symbol: CRYM
  Gene Name: crystallin, mu
  Uniprot ID: Q14894
  ENST ID: ENST00000543948
  CDS Start-End: 193-1137
gtaaaaactcctggaagaaaagatcctgcaatttggctttttgtgagatggaaaagattacaccttgccctgcaaacttcccccctttaaaggcgaaggtttgttagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtg

SEQ ID NO: 122727 - DNA, 1191 bp, Homo sapiens
  Payload ID: 4053
  Gene Symbol: CRYM
  Gene Name: crystallin, mu
  ENST ID: ENST00000574448
  CDS Start-End: 25-522
aggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggttatctaatttttgcataaaatttgcatagtcttctatcaagaagggtgaagaggttaaccatgcacttccggccgggcaaaatgtcctgtttttcaccttgcttggtgaacttgcttagacataaagtttgtttccgtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttggctgcacccatttcactgaatcttaaatgatgctttcaagacagaaggaagaacagtacacctgagatgaccccaaagcctacatcaggcctgctcaacacagcagatcccagatgcttttgagggcaatgaaacaaatctgagatgtac

SEQ ID NO: 122728 - DNA, 874 bp, Homo sapiens
  Payload ID: 4053
  Gene Symbol: CRYM
  Gene Name: crystallin, mu
  ENST ID: ENST00000576703
  CDS Start-End: 151-874
tttcaaatggggagtttccctgcacaagctttcttgtctgccactatgtgagatatacctttcaccttctgccgtgattgtgaggcctcctcagccacgtggaactagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccact

SEQ ID NO: 122729 - DNA, 457 bp, Homo sapiens
  Payload ID: 4053
  Gene Symbol: CRYM
  Gene Name: crystallin, mu
  ENST ID: ENST00000571358
  CDS Start-End: 381-457
tttgttagaggcgcgcgctttcgagctccgcgcgccgaccacgggcagcgggtgggccccctggcgtctggagcagcggccagcgcagaggacgcaggcagaaggaggaagggctggccggggctcccgagcactcactgctcaagcctcgccgccgcctccgccgctgcggggtgcgcgtccatctggttggggctcctcatcccaacaccctccccaacggcccgccgcgcagccgcccgcgggcgagtctgtagcctgatcctgcgcggacccgccagaggcacaccaggagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcc

SEQ ID NO: 122730 - DNA, 461 bp, Homo sapiens
  Payload ID: 4053
  Gene Symbol: CRYM
  Gene Name: crystallin, mu
  ENST ID: ENST00000570401
  CDS Start-End: 1-293
ctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctgctgcacccatttcactgaatcttaaatgatgctttcaagacagaaggaagaacagtacacctgagatgaccccaaaggtgggccttcttttgagaaaatttcaaatgcaaaattccagatttacagatgaaactgtcagtaagacaattcatgggttttcctagtggctttaagctattaaaacttgcaaaactttg

SEQ ID NO: 122731 - DNA, 696 bp, Homo sapiens
  Payload ID: 4053
  Gene Symbol: CRYM
  Gene Name: crystallin, mu
  ENST ID: ENST00000572914
  CDS Start-End: 275-696
tggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcat

SEQ ID NO: 122732 - DNA, 1888 bp, Homo sapiens
  Payload ID: 4054
  Gene Symbol: CRYZ
  Gene Name: crystallin, zeta (quinone reductase)
  Uniprot ID: Q08257
  ENST ID: ENST00000340866
  CDS Start-End: 89-1078
agaaggtgtggcagtcctcatttctgtggaatctgaagaagcccacgcagattttaattcccactctagattctgtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaa

SEQ ID NO: 122733 - DNA, 888 bp, Homo sapiens
  Payload ID: 4054
  Gene Symbol: CRYZ
  Gene Name: crystallin, zeta (quinone reductase)
  ENST ID: ENST00000370870
  CDS Start-End: 159-888
gcacatcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtga

SEQ ID NO: 122734 - DNA, 1292 bp, Homo sapiens
  Payload ID: 4054
  Gene Symbol: CRYZ
  Gene Name: crystallin, zeta (quinone reductase)
  Uniprot ID: Q08257
  ENST ID: ENST00000370871
  CDS Start-End: 81-968
tggcagtcctcatttctgtggaatctgaagaagcccacgcagattttaattcccactctagattctgtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaaggttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaa

SEQ ID NO: 122735 - DNA, 1592 bp, Homo sapiens
  Payload ID: 4054
  Gene Symbol: CRYZ
  Gene Name: crystallin, zeta (quinone reductase)
  Uniprot ID: Q08257
  ENST ID: ENST00000370872
  CDS Start-End: 200-778
agtcctcatttctgtggaatctgaagaagcccacgcagattttaattcccactctagattctggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaacctg

SEQ ID NO: 122736 - DNA, 2301 bp, Homo sapiens
  Payload ID: 4054
  Gene Symbol: CRYZ
  Gene Name: crystallin, zeta (quinone reductase)
  Uniprot ID: Q08257
  ENST ID: ENST00000417775
  CDS Start-End: 506-1495
agtaggatgcggccagcgcaggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacatcctgggtggagcgaggcgcacatcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatt

SEQ ID NO: 122737 - DNA, 677 bp, Homo sapiens
  Payload ID: 4054
  Gene Symbol: CRYZ
  Gene Name: crystallin, zeta (quinone reductase)
  ENST ID: ENST00000441120
  CDS Start-End: 59-677
aagccattcccctccaggggctgcaagttcccatccataaatcagtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattg

SEQ ID NO: 122738 - DNA, 1685 bp, Homo sapiens
  Payload ID: 4055
  Gene Symbol: CRYZL1
  Gene Name: crystallin, zeta (quinone reductase)-like 1
  ENST ID: ENST00000290244
  CDS Start-End: 245-1249
tttattggtagtccttggggcggggcctcgcctctttctccgcccccgagcggaacatgacgggagatgtagttccgagaccggttgccatggcgttctggacagcctcgcgagtccgaccccgcccttcaggagtgacgagcggcctgaccaatgggagcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttg

SEQ ID NO: 122739 - DNA, 2224 bp, Homo sapiens
  Payload ID: 4055
  Gene Symbol: CRYZL1
  Gene Name: crystallin, zeta (quinone reductase)-like 1
  ENST ID: ENST00000361534
  CDS Start-End: 141-1118
gcagggggcgggctctctgacgaaggactggaaggtggcggtggtgaaggtgcaggccgttggggcggctcagaggcagccacttctttcttcctcatcactttgctgttttcggaaagcagttagtagttattcgctgtatgtggcttttgagccagatcggccctcttcattatgctaaacggcggaatcatctggagcgagatgtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgtataaaggccagttccctccaggagcaatgacagtctttattcggagctttaaggtagttatgtaggccgggcatggtggcacatgcctgtaatcccagctactcatgaggctgaggcagaagaatcgcttgaacctgggaggcagaggtttcagtgagccaagattgcactactacactccagcctggtgacagagtgagactccatctcaaaaaaaaaaaaaaaaaaaaaaagttacgtaattagtatactgcatgtgttaagttttaaggagtagatttcaaaaccccttcatgtagtgaatgtatgagtttaaagttatttctgattaaatatttcctattaaatttgaaaattagatttaa

SEQ ID NO: 122740 - DNA, 1482 bp, Homo sapiens
  Payload ID: 4055
  Gene Symbol: CRYZL1
  Gene Name: crystallin, zeta (quinone reductase)-like 1
  ENST ID: ENST00000381540
  CDS Start-End: 74-1042
ctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttctacgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagct

SEQ ID NO: 122741 - DNA, 1617 bp, Homo sapiens
  Payload ID: 4055
  Gene Symbol: CRYZL1
  Gene Name: crystallin, zeta (quinone reductase)-like 1
  Uniprot ID: O95825
  ENST ID: ENST00000381554
  CDS Start-End: 87-1136
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaa

SEQ ID NO: 122742 - DNA, 612 bp, Homo sapiens
  Payload ID: 4055
  Gene Symbol: CRYZL1
  Gene Name: crystallin, zeta (quinone reductase)-like 1
  ENST ID: ENST00000399442
  CDS Start-End: 103-177
cggtggtgaaggtgcaggccgttggggcggctcagaggcagccacttctttcttcctcatcactttgctgttttcggaaagcagttagtagttattcgctgtatgtggcttttgagccagatcggccctcttcattatgctaaacggcggaatcatctggagcgagatacccaatgaactacattgagctcaggagagttttatgagcagaagagcaaaaatacacatattggccgagcgtggtggctcacgcctgtaatcccagcactttgggaggcctaggcgggtggatcacttgaggccaggagttcgagaccagcctggccaacatggtgaaaccccgtgtctactaaaaatacagaaattagccgggcatggtggtgcacgcctgtaattccagctactcaggaggctgaggcaggagaattgcttgaacccgggaggcggaggttacagtgagccaagatcacgaccaccacactctagcctgggcaacagagtgagaccctgtctcaaaaaaaaaaaaaaaaatacacatctatatatgctaaaatatggtattttacaaaaaaaaaagtcttccattttatgcataataaagacatgaaatta

SEQ ID NO: 122743 - DNA, 629 bp, Homo sapiens
  Payload ID: 4055
  Gene Symbol: CRYZL1
  Gene Name: crystallin, zeta (quinone reductase)-like 1
  ENST ID: ENST00000426935
  CDS Start-End: 156-629
ctctgacgaaggactggaaggtggcggtggtgaaggtgcaggccgttggggcggctcagaggcaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttg

SEQ ID NO: 122744 - DNA, 627 bp, Homo sapiens
  Payload ID: 4055
  Gene Symbol: CRYZL1
  Gene Name: crystallin, zeta (quinone reductase)-like 1
  ENST ID: ENST00000413017
  CDS Start-End: 49-390
gcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttgaagtactttcccggctgggtgctgtggctcacgtctgtaatcccagcacgttgggaggccaaggtgggcgaatcacctgaggtcgggagttcgagaccagcctgaccaacatggagaaacctcgtctctactaaaaatacaaaattagccaggcatggtggcacatgcctgtaatcccagctactcaggaggctgaggcaggaaaattgcttaaacccaggaggcagaggttgtggtgagccgagatcacaccattgcactccagcctgggcaagaagaatgaaactccatctcaaaaaaataaagaaagaaagaaa

SEQ ID NO: 122745 - DNA, 535 bp, Homo sapiens
  Payload ID: 4055
  Gene Symbol: CRYZL1
  Gene Name: crystallin, zeta (quinone reductase)-like 1
  ENST ID: ENST00000441940
  CDS Start-End: 1-335
tgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattc

SEQ ID NO: 122746 - DNA, 824 bp, Homo sapiens
  Payload ID: 4055
  Gene Symbol: CRYZL1
  Gene Name: crystallin, zeta (quinone reductase)-like 1
  ENST ID: ENST00000445393
  CDS Start-End: 57-650
ggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataa

SEQ ID NO: 122747 - DNA, 1935 bp, Homo sapiens
  Payload ID: 4055
  Gene Symbol: CRYZL1
  Gene Name: crystallin, zeta (quinone reductase)-like 1
  ENST ID: ENST00000429827
  CDS Start-End: 68-619
gacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgtataaaggccagttccctccaggagcaatgacagtctttattcggagctttaaggtagttatgtaggccgggcatggtggcacatgcctgtaatcccagctactcatgaggctgaggcagaagaatcgcttgaacctgggaggcagaggtttcagtgagccaagattgcactactacactccagcctggtgacagagtgagactccatctcaaaaaaaaaaaaaaaaaaa

SEQ ID NO: 122748 - DNA, 504 bp, Homo sapiens
  Payload ID: 4055
  Gene Symbol: CRYZL1
  Gene Name: crystallin, zeta (quinone reductase)-like 1
  ENST ID: ENST00000417979
  CDS Start-End: 183-504
ggaaggtggcggtggtgaaggtgcaggccgttggggcggctcagaggcagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaa

SEQ ID NO: 122749 - DNA, 607 bp, Homo sapiens
  Payload ID: 4055
  Gene Symbol: CRYZL1
  Gene Name: crystallin, zeta (quinone reductase)-like 1
  ENST ID: ENST00000431177
  CDS Start-End: 64-607
ggtggctcatgcctgtaatcccagcatttcgggaggccgaggcagacggatcacaaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagata

SEQ ID NO: 122750 - DNA, 595 bp, Homo sapiens
  Payload ID: 4055
  Gene Symbol: CRYZL1
  Gene Name: crystallin, zeta (quinone reductase)-like 1
  ENST ID: ENST00000437996
  CDS Start-End: 1-52
gcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagcc

SEQ ID NO: 122751 - DNA, 620 bp, Homo sapiens
  Payload ID: 4055
  Gene Symbol: CRYZL1
  Gene Name: crystallin, zeta (quinone reductase)-like 1
  ENST ID: ENST00000438788
  CDS Start-End: 562-620
ccgttccacgggattagcaaaactgcctccccgctgacagaactgagaatttctagaggcatttgtttgtatgggatttgctgttattatctaccctcttcattggccttgcctttattatctgtacgttttgatcaagaggagcagcaagagaagaatgccaacagacaagcacaaagaaacgcatctggccggagcctgcatgtatctaaatttccaggttgctgctgccctcagaatagcactgatgatggcaaagttctagaggaaactttcatattgaagaggctataaaaatctctatagcctccaactccacagagaagccgctaatctatttcttccaaagcaaagccttcttgagtctgaatcacaacaaaagattgcccataggaaatgtaatctccgaagttgttttctaatcccaaggcaagcagaagcgcaggaaggtgcggccgattcctcgccggtttcctttttttgggaattcggattgcattcgtgcaagcaagggactgcaattgtgtcttgggtccacaccacaaaaccgtgtcggtgactatgaaaggcttatatttccaacagagttccacagatgaagaaataacatttgtatttca

SEQ ID NO: 122752 - DNA, 408 bp, Homo sapiens
  Payload ID: 4055
  Gene Symbol: CRYZL1
  Gene Name: crystallin, zeta (quinone reductase)-like 1
  ENST ID: ENST00000414079
  CDS Start-End: 1-294
catctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggaggttatatttttcagcattctagttacatatttacatgatggctgatatgcaaataccgtaattctcacctaccaatcttcactgattttccaacaccctcatgaagatggccagaaaagacacacacacacccctaccacttcaccaccagg

SEQ ID NO: 122753 - DNA, 1026 bp, Homo sapiens
  Payload ID: 4055
  Gene Symbol: CRYZL1
  Gene Name: crystallin, zeta (quinone reductase)-like 1
  ENST ID: ENST00000440526
  CDS Start-End: 1-724
ggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatata

SEQ ID NO: 122754 - DNA, 1556 bp, Homo sapiens
  Payload ID: 4055
  Gene Symbol: CRYZL1
  Gene Name: crystallin, zeta (quinone reductase)-like 1
  ENST ID: ENST00000452420
  CDS Start-End: 1-289
tagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaagagctaaacttgacgtcctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagc

SEQ ID NO: 122755 - DNA, 2558 bp, Homo sapiens
  Payload ID: 4055
  Gene Symbol: CRYZL1
  Gene Name: crystallin, zeta (quinone reductase)-like 1
  Uniprot ID: O95825
  ENST ID: ENST00000420072
  CDS Start-End: 665-1261
actggccccgcccaccgtgcgaacccaaagagggtgagccaaagaaatgtaagacaacagagtgacaagccgaatgagccaatcagcaggggctgtgtgggggcaggattagcactctccccctcctccccatgtaggcgtaacaggagatttatggtctgaggttgcctatcgtggtttatggagattttgttgcacgatttcggtgcatctgctcgttgccgtgagagacactagataggatgcacttaattgacttaattattggaggttttcaaggagagaataatgtggaaaggaaaaaggcgaagcacaacccaaaggggttggccgggcctatggttggaatgaggaagggtgtggtcttcggctaaaatttgcataaaacggaacccatccgggcgattccaacttcgcccatttattggtagtccttggggcggggcctcgcctctttctccgcccccgagcggaacatgacgggagatgtagttccgagaccggttgccatggcgttctggacagcctcgcgagtccgaccccgcccttcaggagtgacgagcggcctgaccaatgggagcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgtataaaggccagttccctccaggagcaatgacagtctttattcggagctttaaggtagttatgtaggccgggcatggtggcacatgcctgtaatcccagctactcatgaggctgaggcagaagaatcgcttgaacctgggaggcagaggtttcagtgagccaagattgcactactacactccagcctggtgacagagtgagactccatctc

SEQ ID NO: 122756 - DNA, 3553 bp, Homo sapiens
  Payload ID: 4056
  Gene Symbol: CSE1L
  Gene Name: CSE1 chromosome segregation 1-like (yeast)
  Uniprot ID: P55060
  ENST ID: ENST00000262982
  CDS Start-End: 124-3039
gtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaa

SEQ ID NO: 122757 - DNA, 3459 bp, Homo sapiens
  Payload ID: 4056
  Gene Symbol: CSE1L
  Gene Name: CSE1 chromosome segregation 1-like (yeast)
  Uniprot ID: P55060
  ENST ID: ENST00000396192
  CDS Start-End: 190-2937
agagcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaa

SEQ ID NO: 122758 - DNA, 2767 bp, Homo sapiens
  Payload ID: 4057
  Gene Symbol: CSK
  Gene Name: c-src tyrosine kinase
  Uniprot ID: P41240
  ENST ID: ENST00000220003
  CDS Start-End: 730-2082
gcaggcgcgctgccgcgggcggaggatccgggccgcgcttcctctcgccaggcctgcgagcttcctcccagcggagccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgag

SEQ ID NO: 122759 - DNA, 1900 bp, Homo sapiens
  Payload ID: 4057
  Gene Symbol: CSK
  Gene Name: c-src tyrosine kinase
  Uniprot ID: P41240
  ENST ID: ENST00000439220
  CDS Start-End: 179-1531
ccgcgcttcctctcgccaggcctgcgagcttcctcccagcggagccctgggcgagccgaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagc

SEQ ID NO: 122760 - DNA, 578 bp, Homo sapiens
  Payload ID: 4057
  Gene Symbol: CSK
  Gene Name: c-src tyrosine kinase
  ENST ID: ENST00000569915
  CDS Start-End: 385-578
gaacagtagctggaaccaggcctggggctgacggtcaggtgtccattgtcccactagccccctttgctcctttctatcagtcctggaaggccccctgtggccttagggttggtggctccctctgcccctgggggtcctcagccctcatgctcctctacccagtaccgtcagcctgccaggactggagagaatggcccatgtgtcaaatcccagcgcaggacactcttggcacctgttcatgcccagtgaggagccagatctcagcagttggggggcatttcttcacacccctcctcagtcttcatgctcttccccacagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgt

SEQ ID NO: 122761 - DNA, 2443 bp, Homo sapiens
  Payload ID: 4057
  Gene Symbol: CSK
  Gene Name: c-src tyrosine kinase
  Uniprot ID: P41240
  ENST ID: ENST00000567571
  CDS Start-End: 433-1785
attctgcagcccatcctgctggaggagtgtactgagctcccagtccaccctaaaccacaggccacaaccagtgaggttctcactggagcacggggatgtgtgagaggccttggaggcctcggcagccaacacagctggggacccaaggaattctccagagagaggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgcc

SEQ ID NO: 122762 - DNA, 556 bp, Homo sapiens
  Payload ID: 4057
  Gene Symbol: CSK
  Gene Name: c-src tyrosine kinase
  ENST ID: ENST00000567123
  CDS Start-End: 352-556
atacctctttgtaccgcaccccctggggacccctgcgcccctcccctcccccctgaccgcatggaccgtcccgcaggccgctgatgccgcccgcggcgaggtggcccggaccgcagtgccccaagagaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgaga

SEQ ID NO: 122763 - DNA, 534 bp, Homo sapiens
  Payload ID: 4057
  Gene Symbol: CSK
  Gene Name: c-src tyrosine kinase
  ENST ID: ENST00000569462
  CDS Start-End: 203-534
ccgcaccccctggggacccctgcgcccctcccctcccccctgaccgcatggaccgtcccgcaggccgctgatgccgcccgcggcgaggtggcccggaccgcagtgccccaagagagtcttcatgctcttccccacagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaa

SEQ ID NO: 122764 - DNA, 3483 bp, Homo sapiens
  Payload ID: 4058
  Gene Symbol: CSRP2BP
  Gene Name: CSRP2 binding protein
  ENST ID: ENST00000377681
  CDS Start-End: 210-2555
tcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaa

SEQ ID NO: 122765 - DNA, 3618 bp, Homo sapiens
  Payload ID: 4058
  Gene Symbol: CSRP2BP
  Gene Name: CSRP2 binding protein
  Uniprot ID: Q9H8E8
  ENST ID: ENST00000435364
  CDS Start-End: 342-2690
agaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaa

SEQ ID NO: 122766 - DNA, 949 bp, Homo sapiens
  Payload ID: 4058
  Gene Symbol: CSRP2BP
  Gene Name: CSRP2 binding protein
  ENST ID: ENST00000464792
  CDS Start-End: 781-949
ctctgcccgctcggttcctcagctcctcttcgtgtctttcccccgcggtggcgcggccctgcaccccacgcgtttgcggctgcggccggcggccgctctgctgggctccgggcgctgcagctcccggcgggcgtgtgcagcccgcagattcaggacgacccggctgcccggcttagcgcctttggagctccgcgctgaaggggccttgctccgcacaggcacggcacgcaagcttttggggtgcccagtggctctgttttcaagtcacagccggcccgcagggtgcggacctttccacatctcacttgggccgctagaaaatagaagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtgggg

SEQ ID NO: 122767 - DNA, 3152 bp, Homo sapiens
  Payload ID: 4058
  Gene Symbol: CSRP2BP
  Gene Name: CSRP2 binding protein
  Uniprot ID: Q9H8E8
  ENST ID: ENST00000489634
  CDS Start-End: 260-2224
attttgcaattgtgggttggctgaagaaaagaagacaacatgggaaaggaaaatctgggtgataaacggattaaacctttaggttaccgctgctctagataaacccatgatgtgactttttgtttttctcctaggtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaa

SEQ ID NO: 122768 - DNA, 2587 bp, Homo sapiens
  Payload ID: 4059
  Gene Symbol: CTAGE15
  Gene Name: CTAGE family, member 15
  Uniprot ID: A4D2H0
  ENST ID: ENST00000420911
  CDS Start-End: 18-2351
agagcagcctcgacgctatggaggagcccggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggacaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagctcagccgtgccactgaacagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcacttgatgtttcaaatacagcatttggcagagagcatgccccgaatggtcccgcaccattgggtcagcgttcatctgaaacgagagcttttctctctcctcaaactttgttggaggatccactgggactctcacctgtgcttccggagggaggaggaagaggcccaagaggcccagggaatcccctggaccatcagattaccaatgaaagaggagaaccaagctgtgacaggttaaccgatcctcacagggctccttctgacactgggtccctgtcatctccggtggaacaggactgtaagatgatgtttcctccaccaggacaatcatatcctgattcagctcttcctcctcaaagggaagacagattttattctaattctgaaagactgtctggatcagcagaacccagaagttttaaaatgacttctttggataaaatggatgggtcaatgccttcagaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctacccaccgaggggtttacctccttactttcacccgagacctggattttaccccaaccccgcattctgaaggtagaagcgagttcccttcaggattgattccgcctttaatgctactgaacatccaggaccacaaaagaaacctgacaatattgttgctttcttcaaaagtaattttgactgatctcattttcagtttaagtaactgctattacttaagtgattgcacttttgctcaaattgaagtttaatggaattataattctcaggatagtattttgtaaataaagatgttttaaataggaa

SEQ ID NO: 122769 - DNA, 2588 bp, Homo sapiens
  Payload ID: 4060
  Gene Symbol: CTAGE4
  Gene Name: CTAGE family, member 4
  Uniprot ID: Q8IX94
  ENST ID: ENST00000486333
  CDS Start-End: 39-2372
agtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggagaagtgagtgaacttaataaacagaaaataacatttgaagactccaaagtgcacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagatcagccgtgccactgaagggctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcactcgatgtttcaaatacagcatttggcagagagcattccccatgtagtccctcaccattgggtcggccttcatctgaaacgagagcttttccctctcctcaaactttgttggaggatccactcagactctcacctgtgcttccagggggaggaggaagaggcccaagcagcccagggaatcccctggaccatcagattaccaatgaaagaggagaaccaagctatgacaggttaatcgatcctcacagggctccttctgacactgggtccctgtcatctccggtggaacaggaccgtaggatgatgtttcctccaccagggcaatcatatcctgattcaactcttcctccacaaagggaagacagattttattctaattctgaaagactgtctggaccagcagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggccttattcctccacctcttgctccaatcagcggtccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagaaacctgacaatattgttgctttcttcaaaagtaattttgactgatctcattttcagtttaagtaactgctgttacttaagtgattgcacttttctcaaattgaagtttaatggaataatagttctcaggatagtattt

SEQ ID NO: 122770 - DNA, 3860 bp, Homo sapiens
  Payload ID: 4061
  Gene Symbol: CTAGE5
  Gene Name: CTAGE family, member 5
  Uniprot ID: O15320
  ENST ID: ENST00000280083
  CDS Start-End: 315-2729
tgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaacgttgcccagttggttgttttagtattagacttttttttcaatgccaaaagatagaagattaaatattcttgaataaagcagtgatatatattggaacacttcaccccagcatttccccaggtgttgtttggaacactgatcttgtgaagtatttttgctccctttctattctaaccctcacctcaaaaaaaaaaaacaaaa

SEQ ID NO: 122771 - DNA, 4091 bp, Homo sapiens
  Payload ID: 4061
  Gene Symbol: CTAGE5
  Gene Name: CTAGE family, member 5
  Uniprot ID: O15320
  ENST ID: ENST00000341502
  CDS Start-End: 215-2530
gtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagcgcacgctctccgcccggggcaggagccccggcttcaggtaggggcctaggagggccccagaaatgaagccgaagcattggcggatgagactaacgagatctgtgacgactcgtatctgttcaagtggaacagaagccagaaggccctacagtgccgggtagctggcggcgggtaatcaaattgaagccttggcctaactgtctcggaggctgccatcttgcttggtgctcaacggaagccgactttcaagccttattgtttaaggaatacattttataagactatagctaccatagatagtatttcatctgatggatttgggaaaagtaaagtgaaaacctcaaaaggattcacccttctagatgccattcagagtatttgtgattcatgggaggagattaaagtatcaacattaactggactttgtaaggagtggattccatgtttaaggagtccattccatggaatccatggaatgattttgaggggtctaagacatcaggggaagaggtcaccgcatatgtggtggaagtagcaagagaactagaatcagaagtggagcctgacaatgtgactaaagtgctgctgcaatctcatgataaaacttgaacaaatgaggaattgcttctatggatcagtaaaaaaagtgtgtttttgagatggaatttactcctggtgaagatgctgtgaacattgttgaaataacacaatacttcagatattccatacacttagtagataaagctgccgcagagttcgagaggattgagtccaattttgaaagaagttctgtggggaaaaagctataaaacatcatggcatactacagagaaaatgtccacaaaaagaaggaatggatgcggcagatttcactgttgtctcatttaagaaattgccagagccacccagccttcatcaaccaccactgccatcagtcagcagctatcaacatggaggtgatatcctccaccaggaaaaagattatgactcgctgaaggctcagattattattagcattttttagcaatattttaaaagttaaggtctgtacattttttagacataatgctattgtacacctaatacatttcagtataaacataacttttatgtgcattgtgaaaccaaaaagtttgtgtgacttgctatattgcattattctctttattgtagtggtctggaactgaacctgcaatatctccaaggtagggctgtaccataatgccgagttcccccatctgctaatcatttattgccttatggaaaaacaattgttttcatcagaaattagaatttaactttggtcaatatacaaagctgttgataaagtaaggcatacccatgtagagtatttattgacagctatccaaacaatcttacattttttccttcatgtttttcttttcaaagaggcagttttattttgctgcattgttactgtaatttcaaactttatagtttaaacctgttttttcatgtctttccatatccctttaagtctaaattttatgtccttacctgatttccctctgaaaaatgttttccagagatgtagtgatattgtgatattaatgctaacccaaatgttaatatgccattcatttgagaaatatatttgagagtcttc

SEQ ID NO: 122772 - DNA, 2912 bp, Homo sapiens
  Payload ID: 4061
  Gene Symbol: CTAGE5
  Gene Name: CTAGE family, member 5
  Uniprot ID: O15320
  ENST ID: ENST00000341749
  CDS Start-End: 104-2482
gagtgcaggatatattagaatctgaaatctttctcaaggatatgaggtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataa

SEQ ID NO: 122773 - DNA, 2762 bp, Homo sapiens
  Payload ID: 4061
  Gene Symbol: CTAGE5
  Gene Name: CTAGE family, member 5
  Uniprot ID: O15320
  ENST ID: ENST00000348007
  CDS Start-End: 47-2332
gacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataa

SEQ ID NO: 122774 - DNA, 3695 bp, Homo sapiens
  Payload ID: 4061
  Gene Symbol: CTAGE5
  Gene Name: CTAGE family, member 5
  Uniprot ID: O15320
  ENST ID: ENST00000396158
  CDS Start-End: 337-2766
cgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggtagaaaatcaaatggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 122775 - DNA, 3071 bp, Homo sapiens
  Payload ID: 4061
  Gene Symbol: CTAGE5
  Gene Name: CTAGE family, member 5
  Uniprot ID: O15320
  ENST ID: ENST00000396165
  CDS Start-End: 585-2912
aaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaa

SEQ ID NO: 122776 - DNA, 3441 bp, Homo sapiens
  Payload ID: 4061
  Gene Symbol: CTAGE5
  Gene Name: CTAGE family, member 5
  Uniprot ID: O15320
  ENST ID: ENST00000553352
  CDS Start-End: 733-3060
caaaagccttaggctgtgttgtgctgaaggtctgctgtggggagaagtaatgtggaaaggccatggtcagaagatcagggtctttggaggagataatataaataattacccttttttgagcacctgtctggcatgttcaaacagcattattctcattacacttaagagaagggacgcacagaggtagggtggggagattcaaactccaaacccaaatctctatcagtggtgttcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgattt

SEQ ID NO: 122777 - DNA, 2869 bp, Homo sapiens
  Payload ID: 4061
  Gene Symbol: CTAGE5
  Gene Name: CTAGE family, member 5
  Uniprot ID: O15320
  ENST ID: ENST00000557038
  CDS Start-End: 269-2443
gaatctgaaatctttctcaaggatatgaggtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttagatcggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttct

SEQ ID NO: 122778 - DNA, 527 bp, Homo sapiens
  Payload ID: 4061
  Gene Symbol: CTAGE5
  Gene Name: CTAGE family, member 5
  ENST ID: ENST00000554392
  CDS Start-End: 112-527
aaacagaagagtgcaggatatattagaatctgaaatctttctcaaggatatgaggtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggagtttgttgaaggatcacaaatatcagaggcaacctgtgaaaagctgaacaggtccaattctgaacttga

SEQ ID NO: 122779 - DNA, 558 bp, Homo sapiens
  Payload ID: 4061
  Gene Symbol: CTAGE5
  Gene Name: CTAGE family, member 5
  ENST ID: ENST00000555716
  CDS Start-End: 105-558
agagtgcaggatatattagaatctgaaatctttctcaaggatatgaggtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttagatcggttaggagtcggctttatgtgggacgagagaaaaagcttgctctaatgctttctggactaattgaagaaaaaagtaaactacttgaaaaatttagccttgttcaaaaagaggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaag

SEQ ID NO: 122780 - DNA, 2526 bp, Homo sapiens
  Payload ID: 4061
  Gene Symbol: CTAGE5
  Gene Name: CTAGE family, member 5
  Uniprot ID: O15320
  ENST ID: ENST00000556148
  CDS Start-End: 180-2369
cccgacaggccggggttactgtggcgaccacgagagcagctttggcgctatggaggagcccggggttacccctcaaccgtatttggggctgctcctggaggagctacgcagggttgtggcagcactgcctgaaggttaggagtcggctttatgtgggacgagagaaaaagcttgctctaatgctttctggactaattgaagaaaaaagtaaactacttgaaaaatttagccttgttcaaaaagagtatgaaggctatgaagtagagtcatctttaaaggatgccagctttgagaaggaggcaacagaagcacaaagtttggaggtagaaaatcaaatggcaacctgtgaaaagctgaacaggtccaattctgaacttgaggatgaaatactctgtctagaaaaagagttaaaagaagagaaatccaaacattctgaacaagatgaattgatggcggatatttcaaaaaggatacagtctctagaagatgagtcaaaatccctcaaatcacaagtagctgaagccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagataatcctccaaaaggagctttgaagaaactgattcatgctgctaagttaaatgcttctttaaaaaccttagaaggagaaagaaaccaaatttatattcagttgtctgaagttgataaaacaaaggaagagcttacagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggaaattaacagtagaggaaaattatcggttagagaaagaagagaaactttctaaagtagatgaaaagatcagccatgccactgaagagctggagacctatagaaagcgagccaaagatcttgaagaagaattggagagaactattcattcttatcaagggcagattatttcccatgagaaaaaagcacatgataattggttggcagctcggaatgctgaaagaaacctcaatgatttaaggaaagaaaatgctcacaacagacaaaaattaactgaaacagagcttaaatttgaacttttagaaaaagatccttatgcactcgatgttccaaatacagcatttggcagagagcattccccatatggtccctcaccattgggttggccttcatctgaaacaagagcttttctctctcctccaactttgttggagggtccactcagactctcacctttgcttccagggggaggaggaagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatg

SEQ ID NO: 122781 - DNA, 2608 bp, Homo sapiens
  Payload ID: 4062
  Gene Symbol: CTAGE6
  Gene Name: CTAGE family, member 6
  Uniprot ID: Q86UF2
  ENST ID: ENST00000470691
  CDS Start-End: 39-2372
agtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggagaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagaatctttgcaatcagaaaacatatattttgaaagtgagaatcagaagcttcaacagaaacttaaaataatgactgaattctatcaagaagatgaaatgaaactctataggaaattaacagtggaggaaaattaccgaatagaggaagaagagaagctttctaaagtggaagaaaagctcagccgtgccactgaacagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcacttgatgtttcaaatacagcatttggcagagagcatgccccgaatggtcccgcaccattgggtcagcgttcatctgaaacgagagcttttctctctcctcaaactttgttggaggatccactgggactctcacctgtgcttccggagggaggaggaagaggcccaagaggcccagggaatcccctggaccatcagattaccaatgaaagaggagaaccaagctgtgacaggttaaccgatcctcacagggctccttctgacactgggtccctgtcatctccggtggaacaggactgtaagatgatgtttcctccaccaggacaatcatatcctgattcagctcttcctcctcaaagggaagacagattttattctaattctgaaagactgtctggatcagcagaacccagaagttttaaaatgacttctttggataaaatggatgggtcaatgccttcagaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctacccaccgaggggtttacctccttactttcacccgagacctggattttaccccaaccccgcattctgaaggtagaagcgagttcccttcaggattgattccgcctttaatgctactgaacatccaggaccacaaaagaaacctgacaatattgttgctttcttcaaaagtaattttgactgatctcattttcagtttaagtaactgctattacttaagtgattgcacttttgctcaaattgaagtttaatggaattataattctcaggatagtattttgtaaataaagatgttttaaataggaa

SEQ ID NO: 122782 - DNA, 2588 bp, Homo sapiens
  Payload ID: 4063
  Gene Symbol: CTAGE8
  Gene Name: CTAGE family, member 8
  Uniprot ID: P0CG41
  ENST ID: ENST00000487179
  CDS Start-End: 39-2372
agtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggacaagtgagtgaacttaataaacagaaaataacatttgaagactccaaagtgcacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagatcagccgtgccactgaagggctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaacagagttgaaatttgaacttttagaaaaagatcctaatgcactcgatgtttcaaatacagcatttggcagagagcattccccatgtagtccctcaccattgggtcggccttcatctgaaacgagagcttttccctctcctcaaactttgttggaggatccactcagactctcacctgtgcttccagggggaggaggaagaggcccaagcagcccagggaatcccctggaccatcagattaccaatgaaagaggagaaccaagctatgacaggttaatcgatcctcacagggctccttctgacactgggtccctgtcatctccggtggaacaggaccgtaggatgatgtttcctccaccagggcaatcatatcctgattcaactcttcctccacaaagggaagacagattttattctaattctgaaagactgtctggaccagcagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagaaacctgacaatattgttgctttcttcaaaagtaattttgactgatctcattttcagtttaagtaactgctgttacttaagtgattgcacttttctcaaattgaagtttaatggaataatagttctcaggatagtattt

SEQ ID NO: 122783 - DNA, 2334 bp, Homo sapiens
  Payload ID: 4064
  Gene Symbol: CTAGE9
  Gene Name: CTAGE family, member 9
  Uniprot ID: A4FU28
  ENST ID: ENST00000314099
  CDS Start-End: 1-2334
atggaggagcctggtgctacccctcagccctacctggggctggtcctggaggagctaggcagagttgtggcagcactacctgagagtatgagaccagatgagaatccttatggttttccatcggaactggtggtatgtgcagctgttattggattttttgttgttctcctttttttgtggagaagttttagatcggttaggagtcggctttatgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgagcaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggacaagtgagtgaacttaataaacagaaaataacatttgaagactccaaagtacacgcagaacaagttctgaatgataaagaaaatcacatcaagaccctgactggacacttgccaatgatgaaagatcaggctgctgtgcttgaagaagacacaacggatgatgataacctggaattaaaagtgaacagtcaatgggaaaatggtgctaacttagatgatcctccgaaaggagctttgaagaaactgattcatgctgctaagttaaatgtttctttaaaaagcttagaaggagaaagaaaccacattattattcagttatctgaagtggacaaaacaaaggaagagcttacagagcatattaaaaatcttcagactcaacaagcatctttgcaatcagaaaacatatattttgaaagtgagaatcagaagcttcaacagaaacttaaaataatgactgaattctatcaagaaaatgaaatgaaactctacaggaaattaacagtggaggaaaattaccgaatagaggaagaagagaagctttctagagtggaagaaaagatcagccatgccactgaagagctggagacctatagaaagctagccaaagatcttgaagaagaattggagagaactgttcatttttatcaaaagcaggttatttcctacgagaaaagaggacatgataattggttggcagctcggactgctgaaagaaacctcagtgatttaaggaaagaaaatgctcacaacaaacaaaaattaactgaaagagagttgaaatttgaacttttagaaaaagatcctaatgcactcgatgtttcaaatacagcatttggcagagagcattccccatgtagtccctcaccattgggtcggccttcatctgaaacgagagcttttccctctcctcaaactttgttggaggatccactcagactctcacctgtgcttccagggggaggaggaagaggcccaagcagcccagggaatcccctggaccatcagattaccaatgaaagaggagaaccaagctatgacaggttaatcgatcctcacagggctccttctgacactgggtccctgtcatctccggtggaacaggaccgtaggatgatgtttcctccaccagggcaatcatatcctgattcaactcttcctccacaaagggaagacagattttattctaattctgaaagactgtctggaccagcagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggccttattcctccacctcttgctccaatcagcggtccattgtttccagtggatacaaggggcccattcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctga

SEQ ID NO: 122784 - DNA, 487 bp, Homo sapiens
  Payload ID: 4065
  Gene Symbol:
  Gene Name: CTB-102L5.4
  ENST ID: ENST00000587519
  CDS Start-End: 1-419
ggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggccctggagcccacctcccagaagcccggtgtgggggcgggccacgggggagatcccaagctcagtccccacaaagttcagggccggtcggaggcaggggcaggtccgggtccaaagcaaggacaccacagctcttccgactccagcagcagctccagcgattcggacacggatgtgaagtcccacgctgctggctccaagcagcacgagagcatcccgggcaaggccaagaagcccaaagtgaag

SEQ ID NO: 122785 - DNA, 528 bp, Homo sapiens
  Payload ID: 4065
  Gene Symbol:
  Gene Name: CTB-102L5.4
  ENST ID: ENST00000591889
  CDS Start-End: 1-461
ccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggccctggagcccacctcccagaagcccggtgtgggggcgggccacgggggagatcccaagctcagtccccacaaagttcagggccggtcggaggcaggggcaggtccgggtccaaaggcctccaacttcagggggctgggtaaggggcgccgcctcactgccgcacctccatccagcaaggacaccacagctcttccgactccagcagcagctccagcgattcggacacggatgtgaagtcccacgctgctggctccaagcagcacgagagcatcccgggcaaggccaagaagcccaaagtgaa

SEQ ID NO: 122786 - DNA, 1558 bp, Homo sapiens
  Payload ID: 4066
  Gene Symbol:
  Gene Name: CTB-133G6.1
  Uniprot ID: I3L1I5
  ENST ID: ENST00000576789
  CDS Start-End: 410-1558
cctgcatgcgcagggctgaggggtgggagcagggctctctgcctccagaacccccatcctctgggctctttttaggcccctagattggcctgcagctgggagcagagtggcaagcatgcaggcaggcagttgagaaagaggaagtcgaggtgctattgggtcattctgtggttatcccaggctctacccagccagcggttcccttgggccagctcgaaacgctggccgtaggtcatgggagctgcaggagctgttagccaggctaggtgcctgcaggttgaagaactgagctctatctggctctgagcccaagtcatgtgtccagccttttgactctggagctgtggcttcagccaccaagagcagcagtggatcctggaaacctgagaacccagacttcttctctgccatgggggatgatcaggaggatgattttcccaggcggctcagcgagagtatggaggacctcagcctggatttgggggcccttcagggcagcgagtatctgcaggacctgggccttggggccccttcccacagccagcctggggagaccccagacagccgccccaccggtgaagaaccaggaagagattctcttttctccagcttggcagggtcccaagacctgtcaaggcggcgcagctgggaaaggtcgcggagctgctcagagagctggcggaggctcagcctcgatgcctcagctgtggatgaggaaccctgtctcccccgaacactggccagccttgctttgaacctgccaggaggagggctgaagacctggactcaagggtgtctctctgggggcgggacccccgcagagagcccaggcaaggaatgtgacagccccaagaaaagagggaggtcaaggtccgttcctgtgtccttctatgagatccgctctccggaaatctctccgggtttggaagtgcccactccacctgttcaaggcctggaacctccagtgctggagtgcatggaaaaagaccatgtggaaccagatcacgtgctgattgtccagcaggtgcttcaagaacttcgacagtaccatggggcccggcagagggcttgcatgtcagccagccccggaggagcccactcgaacctgacctggtttgaattcctgtcggagagcgaggacggtgctggcaagaacgagaagagtgacaagagtaccagtgtgaagcgcaggctgagctgcctccgcagtcgagtgaccaggcagaaggagaaggggaagagcccagcacatctgaaggacaagggccaggatgcacgagagaggcgggagtgtgtcaatgggcaccagctgttgcaagggaccttctccggcccctccagctgccccctgtgtggcaaacctttcttgagctcaggtaagtctggtggcccaatccatcctcctggagggcagccactttctcttcttcacgtcctttcaatcatactcctggggtctcttttgatgtgtgcatcctcgttctgttttgccctctcctcggcggctccctggagagaaccagggatcagtccctgggcacagggacccttgggctaa

SEQ ID NO: 122787 - DNA, 1803 bp, Homo sapiens
  Payload ID: 4067
  Gene Symbol:
  Gene Name: CTB-50L17.14
  ENST ID: ENST00000586020
  CDS Start-End: 55-309
ataaggccacctccgcaggccaggacaacccagaagcaaaagagcagagctaccatgtcctcttggagcagacagcgaccaaaaagggtgaccctgtttgcagcacgatgtctgaagaagaggcggctcagatccccagatccagtgtgtgggagcaggaccagcagaacgtggtgcagcgtgtggtggctctgcccctggtcagggccacgtgcaccgcggtctgcgatgtttacagtgcagccaaggacaggcacccgctgctgggctccgcctgccgcctggctgagaactgcgtgtgcggcctgaccacccgtgccctggaccacgcccagccgctgctcgagcacctgcagccccagctggccactatgaacagcctcgcctgcaggggcctggacaagctggaagagaagcttccctttctccagcaaccttcggagacggtaccccggacgactagacatggggacctccagtgggggcaggccagattagaggcgggagggagggagggatggtgacaaccaggcttttagttaactcaagaaaaaacagccaggttaaaataactgcaacgtgtgtgtgtgtgtgtgtgtgtgtgtgtgtgtgtgtgtgtatacatatatgtatatacgtatagtgtatatatgtatatatacgtataagtatatatgtatatatacgtataagtatatatgtatatgtgtatatatacatgtatatatgtatatgtgtgtatatgtgtatatatgtatatgtatgtgtgtatacatatgtattgctagtaagggcagttaactccctcaacaccctctgtgagggaagggttttatcacccattttataggggaaactgaggcacggagccaggtagaagtccagggatctttgagtcccagccccagggaactagggtggcagaaatggagctggagtcccacggtgcctggagtgggggggcccttccttccaggtggtgacctcagccaaggacgtggtggccagcagtgtcacgggtgtggtggacctggcccggaggggccggcgctggagcgtggagctgaagcgctccgtgagccatgctgtggatgttgtactggaaaaatcagaggagctggtggatcacttcctgcccatgacggaggaagagctcggtgaggacgacaccctcaaccctaacccctgagtcctgccccgtccccatcccctgtggtacagatcagagaggtctgagactcacccaaggtcacacagcagatcagcaggaaacatacaactcaaaaccaggcctgtcctccctcccggtcacttccacggcccctcaacctgcatcccgccaggagtcagaacacccagaccctaagggcatatagggcttttagacttgaggtcccaaactggtggcccccaaatgcctgtgcagcgtgttttaaatattttcattctttgcatgcatttaacaaccagattttgcattacatgtcccgattcttggcttgttttgaaaaaccagacacactgccaggcacagtggctcacgcctgtaatctcagcactttgggaggccaaggtgggcagatcatgaggtcaggagttcgagcccagcctggccaacatagtgaaatcccgtctctactaaaaatacaaaaaattagccaggcgtggtggcgtgtgcctgtattcccagatactcgggaggctgaggcaggagaatcacttgaacctgggaggtggaggttgcaatgagctgagatcgcgctattgcactccagcccaggccacagtgcgagactccgtttc

SEQ ID NO: 122788 - DNA, 581 bp, Homo sapiens
  Payload ID: 4068
  Gene Symbol:
  Gene Name: CTB-54O9.9
  ENST ID: ENST00000586012
  CDS Start-End: 1-234
ctgtccttcctgtgccggtacgtgcccgtggggctgctggagcggctcccacagaggatcaacgagcggccgccctactacctgggccgcgactacctggagacgctgatggccagccagaaggcagccgactggatccgcatcaggctccttgaacctgtatcatcccccagacccagagaaagaggtgtttccagccccaccagcaggtaccggcctcccctgagcccttgacgaggctgggagtgggtttgagtgtgcaggcccatcttgcccctgccccgtccctaagtgggagcctgaaggcatggcctctgctccccatgcttcacacaggtcccccagatgagccccaaagacaagctctgtgtcatccatcacccagccagggccccaaagcaatatctatgtcgtcccccaaaggggccccccaatggcaaggttcttgtggcatctcccaaacaggcccccaggcttgggctgggcccctcaggcagcagctgctctcagggcacccgcctgccgcccacaggtttccagatggccccatgcgggtgcttcttcgacccccgcatctatcg

SEQ ID NO: 122789 - DNA, 786 bp, Homo sapiens
  Payload ID: 4069
  Gene Symbol:
  Gene Name: CTB-60B18.6
  ENST ID: ENST00000591656
  CDS Start-End: 398-786
ctggagggaggaaggggaactgcatctgagagagagcagccaattgggtccgctgactctggccaggttcccgtgccgcgtccaacacccctcactccctgtctcactcccccacggagactcaatttactttccatgtccacattcccagtgcttgcggaagatatcccgctaagagagagacatgtcaaaggtagggtagatccacatttccgggcaccaaagatggagatgttccaggaaagactgcagggcccctgggcaccttccacctccttccaggccatcactggcatgagaaggggcagacccgtgtgagctgtggaaggaggcctctttctggaggagcgtgacccccagtaagcttcaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccc

SEQ ID NO: 122790 - DNA, 406 bp, Homo sapiens
  Payload ID: 4069
  Gene Symbol:
  Gene Name: CTB-60B18.6
  ENST ID: ENST00000604577
  CDS Start-End: 175-406
gaaggggaactgcatctgagagagagcagccaattgggtccgctgactctggccaggttcccgtgccgcgtccaacacccctcactccctgtctcactcccccacggagactcaatttactttccatgtccacattcccagtgcttgcggaagatatcccgctaagagagagacatgtcaaaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactacc

SEQ ID NO: 122791 - DNA, 851 bp, Homo sapiens
  Payload ID: 4070
  Gene Symbol:
  Gene Name: CTB-96E2.2
  ENST ID: ENST00000555059
  CDS Start-End: 1-447
ccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacgacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgccttggccattgtcg

SEQ ID NO: 122792 - DNA, 1100 bp, Homo sapiens
  Payload ID: 4071
  Gene Symbol:
  Gene Name: CTC-260F20.3
  ENST ID: ENST00000555938
  CDS Start-End: 13-834
gatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggcatgccaggcagaggggggcacattggggcctggggggcttgggtggaggcccctgtgccccagctcctggtcgcccctgcctgtctgaacctcaatctccccagcttggatggacccacacttggctgaggctaagggtcacacccatccctctgatggggaagatcgaggctgccaccccaggtgaccccaggtctcctctttcctccaccccagtgcccagcccacatgccctctgcccacccctggcccagttgcctgggcagacgtgagctcactcggcaaaggccgcgcccgccctggctgccgccccatgcctgttggaaccattaggcgacaggcagacggaacaaacagccgctggccagccggaccctccgtgggggtggctggac

SEQ ID NO: 122793 - DNA, 443 bp, Homo sapiens
  Payload ID: 4072
  Gene Symbol:
  Gene Name: CTC-273B12.7
  ENST ID: ENST00000595676
  CDS Start-End: 151-443
gtccattaccaaagcctggaagttctcatcacctccaggtggactgcttggcagtgctaggaggtggactcaggacttcagaagcaacatttctggcctgacctggaaggtgaaggtgaagaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggacta

SEQ ID NO: 122794 - DNA, 3537 bp, Homo sapiens
  Payload ID: 4073
  Gene Symbol:
  Gene Name: CTC-281F24.5
  ENST ID: ENST00000634965
  CDS Start-End: 1-3537
atgagccgggagactcgccgtggggccttgcccaggctgcgccggggagagcaggcggctaagatgccgggtcgctgcgtggggcccagcaggtcggggcggggggttcggcggccgtgggggaagagacggggcgcagggacgtcccgaggccgtggagcaaggcgccgggcgaagccctcggagtgggagacgcgctgtgtgagtgcagaaaggccacagggccgtcagcggccatgggggacgagacaagcggcggagacagccgacgccgccggggcgaatgaggctttgggagctcctgggaccccaggctccatcgaggctgcaagggaccctggggctgtgtgggtgaacggggctgtgggggagcccgaggtggtggggcttgccggggctgtgtgggtgaccgggtctggggaggaggagaccgaagatagaagtccccggggctgcgagagaaaaggtcgcccgggatctctgggccatgagagcattctgcacctgtggctgaaggtgcaggctatgagggccgcctcgggatgtggggaaggaagtagagtcgagctccatcccgtgcctgcaggagagggacctgtcgaaaggggtgttcctggccgagcttcctgggtagagacaagccgcggcggtcttacagggccctgggtgaaggaacaggcaagggggatccctcgggccccctcagggcccacagctctgggcttaggggcagcttacgagagagccttaggcttctgtggacagggacaggctgggagggtgcctcctgcgagtgtgcctggggctttggcgtcaagttctgaaatggccccgcacctgtggaggggagaagctgtgggggttcctgagactggggaggagataggctatgggtttgtctcaggcccttgtgaaaaagaacagactatgggcgagcctgggaccgtggggtggactggggctgtgggagcgcccagagccatggagggagagctcggctgtggcggtgctgcaggtctgtgggggagaggacagtccccgcagattcctggggctctgacacatgaagcagtctgtggggccacccctggcgtatgggggaggggacaggctgtgggggtgtccgatgctgtggaggaggagcctacttctgtgggtgccgcaggtgtgtgttacaggagacaggctgtggaggagacagactctgtgggtatgcccggcccgtggggcacaggatactctgttggggtgccctgtgctgctgaagaggaaactagatgtggaggtgacccagggttcagggaaaggggacagcctgtgtgggtggagacaggctctgggggtgatccagggtcacggggagctgcgcagactgcagagtcatcatgtcctggggagcaggcagcaggttctgggggtgccccaggcctgtgggggatacaacaggctacaggggtacccagggccttggggaaggacacgggctgtgtgagtgtcccagggctgtggggagcgggacagatggtaagggtgccccaggctgtggtggtacctggagccctgggagaagagctgagccacagcgggggcctgggcctgtgggacggacagcaagctcttggggggcccccagccgaggcagtgcctgggcttggagaggagacctgtagtgggaatgttctgagcccgtgggaaaggaggcaggctgtgggggagccagagagtctggggcctccagctttaggggtccctgggtcagtggatcaggaggctggctgtggagatgttgcatgtcagtgtgggaggaggcaggctgtgggggtgtctgagacggtgggcatacccagggcagcagatgtgccccggcaggggtgtgccgcagcaggggtcctcatggcaatgggtgtgcccggctctggaaaggtgcctgccagagtgcctgctgctgtgtgggcgtctggtcctgtgtgtcaggaaggcagctctagagacattttgaacctgtgggaaaggactcgggctgccagaatatctgtggcttcggggggacccgtggctcgggaggagctgtggtctggcggggaggaatccgtggcttcagggggacccgtggctcaggaggagctgtggtcaggcggggaggaatccgtggcttcagggggacacgtggctcgggagaagctgtggtctggcggggaggattgtggttctggggccttcccgggcccatgggggaggagacagactattggggttcctgtggtgcctgaggggcctgggcttgggggggagactgactctgggggtatcccaagaccctggggacagagacagagggtcagggctcctgtggccaccgaagtccttctggctcctagggtgcctggttctgtggagctggagcctggtgatggaggcttttcaggcttgtcagggaggcagcaaactgcaggaatgcctggcactgtggggctgtctgcagctagtggggtgcccgtggctcccagggtgcctaggcctgtgcaagaggaaactggctcagaattgtggggtgaaagagagacagtgggcggacctgcagatgccaagggtcccacaaggatggaggtgcccacctcgaccaggatgcctgggcccatggcggagaagactggctctgggggtgtctcaggtttgttgggaggcagacagactacaggagtgtccatggctgtggggctgctggggtctgtgggggaggggaccatctttgagcatgtctctggcctgtctggaagaaggcagactgctgggaggcctgtggctgctagaggttccatggccgtgggagtgcccacagctcccgggcttccagggccaatggtaggggatacgggctctggggatgacggctcaggcatatggggaaggagactggccactgaggggcccacagctgccagggttcctggacctgtggagggggagacaggctctgaaggtgtctcaggcctgtggagaaggagacacggtggagccattcccgaggccgggagggtgcctctgcctctgggggtgcttgcagctgtaggagctcccatggcagggcgtgcgcctgctgcggtgtgggtgactgggtcctcaggagcagaagcggacgtgggtgtctcaggtctgaccgtgctgaggagacagtccacagggggagtgggggcttcagaggatgagacaggaggtgggaatattttgggactggccgggggcagccaggctgtggggacatctcacacctgtgtgcctggggccaggttatggagctgtccaaggtctttgggggaagaaacagcctatgagaatgctctaggcatgtcagggacaagaacagctgtgggggtaccctcagtttcaagggaggaaataggccttggccatttcagagaccacctacagccaagtgggaggaggctggctggaggagtgtctgcagtcagagtgagagggagcaatttgggagagagttatgtgggggaggctagattgaggggggcgttccagtag

SEQ ID NO: 122795 - DNA, 575 bp, Homo sapiens
  Payload ID: 4074
  Gene Symbol:
  Gene Name: CTC-326K19.6
  ENST ID: ENST00000451973
  CDS Start-End: 1-114
aacagctccctgagcctccatggagggctcagctccggcctcaggctccgctgtaaggcctggaacgtccacggggcccagagtggctctgtcttccagctgctaccagggtgaagatctgcaggaaggaagctcgcaagagggcagcagctgagcaggacgtgccctccaccctgggacccatctcccagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacag

SEQ ID NO: 122796 - DNA, 1967 bp, Homo sapiens
  Payload ID: 4075
  Gene Symbol:
  Gene Name: CTC-360G5.8
  ENST ID: ENST00000599996
  CDS Start-End: 1-1765
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattga

SEQ ID NO: 122797 - DNA, 1967 bp, Homo sapiens; identical to SEQ ID NO: 122796
  Payload ID: 4075
  Gene Symbol:
  Gene Name: CTC-360G5.8
  ENST ID: ENST00000634460
  CDS Start-End: 1-1765

SEQ ID NO: 122798 - DNA, 727 bp, Homo sapiens
  Payload ID: 4076
  Gene Symbol:
  Gene Name: CTC-398G3.6
  ENST ID: ENST00000585656
  CDS Start-End: 1-566
gccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctg

SEQ ID NO: 122799 - DNA, 222 bp, Homo sapiens
  Payload ID: 4077
  Gene Symbol:
  Gene Name: CTC-429P9.4
  ENST ID: ENST00000593459
  CDS Start-End: 1-189
ggagacatcctgctgttcgggacgttgctgatgaatgccggggcggtgctgaactttaagctgaaaaagaaggacacgcagggctttggggaggagtccagggagcccagcacagatccggaacatggtggcggtgctggaagtcatctccagcctggagaaataccctattaccaaagaggcacttgaggaaacacgacttgggaagctcatcaacgacgt

SEQ ID NO: 122800 - DNA, 400 bp, Homo sapiens
  Payload ID: 4077
  Gene Symbol:
  Gene Name: CTC-429P9.4
  ENST ID: ENST00000595505
  CDS Start-End: 6-155
taacgatgatcggagacatcctgctgttcgggacgttgctgatgaatgccggggcggtgctgaactttaagctgaaaaagaaggacacgcagggctttggggaggagtccagggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgagatccggaacatggtggcggtgctggaagtcatctccagcctggagaaataccctattaccaaagaggcacttgaggaaacacgacttgggaagctcatcaacgacgtc

SEQ ID NO: 122801 - DNA, 479 bp, Homo sapiens
  Payload ID: 4077
  Gene Symbol:
  Gene Name: CTC-429P9.4
  ENST ID: ENST00000594509
  CDS Start-End: 1-222
ggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgagatccggaacatggtggcggtgctggaagtcatctccagcctggagaaataccctattaccaaagaggcacttgaggaaacacgacttgggaagctcatcaacgacgt

SEQ ID NO: 122802 - DNA, 548 bp, Homo sapiens
  Payload ID: 4077
  Gene Symbol:
  Gene Name: CTC-429P9.4
  ENST ID: ENST00000593991
  CDS Start-End: 1-222
ggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtgatactatttttctatctactggggataccaaaaagagccagtgcccttgaggaaccaagtcatgtcagtgcttcttagtttttaaaaagtggatccggaacatggtggcggtgctggaagtcatctccagcctggagaaataccctattaccaaagaggcacttgaggaaacacgacttgggaagctcatcaacgacgtc

SEQ ID NO: 122803 - DNA, 437 bp, Homo sapiens
  Payload ID: 4077
  Gene Symbol:
  Gene Name: CTC-429P9.4
  ENST ID: ENST00000601636
  CDS Start-End: 11-202
gacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtgatccggaacatggtggcggtgctggaagtcatctccagcctggagaaataccctattaccaaagaggcacttgaggaaacacgacttgggaagctcatcaacgacgtcc

SEQ ID NO: 122804 - DNA, 956 bp, Homo sapiens
  Payload ID: 4077
  Gene Symbol:
  Gene Name: CTC-429P9.4
  ENST ID: ENST00000600705
  CDS Start-End: 6-155
taacgatgatcggagacatcctgctgttcgggacgttgctgatgaatgccggggcggtgctgaactttaagctgaaaaagaaggacacgcagggctttggggaggagtccagggagcccagcacaggctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggtgggtggaaaagtgttcgccgagatccggaacatggtggcggtgctggaagtcatctccagcctggagaaataccctattaccaaagaggcacttgaggtgagtatcccagaccccagcatttgggagggcagaacggggggcaggggatggtaccaaccaggtccttccgcagcttctgggagcatcagtgtctttgcttcggaggaccaagagaggcggtgtgccctcacagctcgtgcctcgcgatcttgctctcccacgggcactgcagagaccaagtggtgttactcccatcctacatgcccagcacacttcgtgggcacgtggggacatcaggagaggtgtgcttggaggaggctccagtgagaggcaccatccccaaccctccacttgaagcggaccctctgtgctgtcgcctcggccacagcaccctctcacccaggaagcctctctggcagtgtccttacagtggccttgatggtccacagccccctgacaccaggagcctgggtgacagcactgctgagaagccacctgggaccctgaaggtctgggaactaggtttgagaatttatattgtcacaaaggaccggaaatccccagaagttttgtgtcagggaagctggcagtttagggctcagtgggaaccgggtcatttcactgtcagggccacttcccaccattt

SEQ ID NO: 122805 - DNA, 6393 bp, Homo sapiens
  Payload ID: 4078
  Gene Symbol:
  Gene Name: CTC-432M15.3
  ENST ID: ENST00000514667
  CDS Start-End: 63-5018
gctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattaccaaaaaaaaaaaaaaaaa

SEQ ID NO: 122806 - DNA, 1960 bp, Homo sapiens
  Payload ID: 4079
  Gene Symbol:
  Gene Name: CTC-435M10.3
  ENST ID: ENST00000540732
  CDS Start-End: 128-1567
aaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgagcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctct

SEQ ID NO: 122807 - DNA, 389 bp, Homo sapiens
  Payload ID: 4080
  Gene Symbol:
  Gene Name: CTC-454I21.3
  ENST ID: ENST00000588873
  CDS Start-End: 1-362
ccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccagtgacacaccgactccccctcccttccaccatgactaaaagcttcctggacctcaccagaagccaagcagacactagtgctatgctcgtacagcctccagaagcatgagctaagtaaatctctttttattataaa

SEQ ID NO: 122808 - DNA, 965 bp, Homo sapiens
  Payload ID: 4080
  Gene Symbol:
  Gene Name: CTC-454I21.3
  ENST ID: ENST00000585860
  CDS Start-End: 144-590
gttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctagtaggtttttactgggattagtgaaacaactgctatgttctcagcaacccactccaaagccaaagtcaaaactaaaattgtaaaatatctcaaaaacaataaaaatggtatatatatatcagaagctctggtatatagcaaaactgtactaaaaataatttagaaaaataatttatctcatgcaaatgaataaaaaaatctaaatgaaaagg

SEQ ID NO: 122809 - DNA, 575 bp, Homo sapiens
  Payload ID: 4080
  Gene Symbol:
  Gene Name: CTC-454I21.3
  ENST ID: ENST00000590245
  CDS Start-End: 216-386
gaaggctatttcgccgctggcgtcaggactattttcacgttttaatgccgagaggtctctgtgacgattttggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgaggtatataggtaccattttcaaagaaatgatgttctgagccctataagcacaatcaatatgcatcacaagagacaaactgtaatctctgaatgcagttaaatgaagaaatcaacaagggggacagagttttgctcttgttgcccaggctggagtgcagtggcacaatcttggctcaccgcaacctctgcctcctgggttcaagcgattctcctgcctcagcctcccgagtagctgagattacaggcatgcaccaccacgcccagggatcagtgtccttcagggatgtgg

SEQ ID NO: 122810 - DNA, 573 bp, Homo sapiens
  Payload ID: 4081
  Gene Symbol:
  Gene Name: CTC-479C5.12
  ENST ID: ENST00000573493
  CDS Start-End: 1-233
cgcagctctacggtgtgcatccccatggctcctacagccgtctgcccttcacagccctgggctctggtcaggacgcggccctggcggtgctagaagaccggttccagccgaacatgacggtgagcggcctctgtccccgactttgtggtcgctggtgggatgtgcacccgggagctgggggagcacaggaccctggcccagtgcgggtggctaaggcttgtcggaggaggtgaccactgaaggctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggacagcagcggcttccacttctgcggtggttctctcatcagccagtcctgggtggtcactgctgcccactgcaat

SEQ ID NO: 122811 - DNA, 1185 bp, Homo sapiens
  Payload ID: 4082
  Gene Symbol:
  Gene Name: CTC-479C5.6
  ENST ID: ENST00000574912
  CDS Start-End: 142-513
ccttaggtgacttcacagggtagtgatgacctcacaagcttccaaagtttccatggcagcgtgactacacacctgcgtcctagagaagcctccctaccatttctctgtaagataccaatctgtttggttggctgagagagaatgactgaccggatcctctatattgtctctaacatgtcctctgtcccctgggagggcagcgcagcagctgcagtgcctgccacttctcctcccacacctgggcactaccatgttctctaccgagggtgtggagaaactcaggtaggctggcatggggagacgtactgcctggttggtggctaccgggtccatggggatgctcctttggccaccccaacaaaggctgaagcagagaagccagcccccaggcgtgctcccaagagacgtcaagctacgatagagtcagataaagacctgggttgctctagccccaaaattcggcgcttggagcatcgtggcaggagactgaccccacagaagcttgctggctgagccatttgggagaaaggacaaatgtttagctgtctaagacagctaatgcctcttctgcggtgacctcccctgcccaccactgcagatagagcctgagtcattctgcctatgccttcctcatccagaagcccccttccatgctaactacccatggccaaggagcctcagaaactgtggtttaaaatgagaggttgctttgaacatcccaaggctgaagacggcctggaagaaaacctgatgttcctctactcatctctccagagtccctttttgggcagaagatagaaatagtctgcactctgctagccgaggagtcaagtgcagagagggagtgcagcatagcccagtaagggcttgatctaccagatgggtctttgctttgagtcactgccagcaactaccagcacaaaccaggagggccaggacttgctgaaactggaagcagcagcccatggctagtcacagcaggagaaagcctcctgcttggcatctcaggaggtagaagaaagagacctggggagacctgccacctacagcaagaacaataaggaggaagttgagcaacatccccctgaagctcacatgttactttatttcctgcccattatggccccagtgaggtccctactgctcaatttaaaaaaaaattaaaaaaattatttttccataaca

SEQ ID NO: 122812 - DNA, 1643 bp, Homo sapiens
  Payload ID: 4083
  Gene Symbol:
  Gene Name: CTC-487M23.8
  ENST ID: ENST00000506997
  CDS Start-End: 83-214
tcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaagtgtttatgtttttaactgttcaggctgttgaaaatcctacagctacagagattcaagatgtatgttcagcagttggacttaacgtatttcttgaggttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggacc

SEQ ID NO: 122813 - DNA, 575 bp, Homo sapiens
  Payload ID: 4084
  Gene Symbol:
  Gene Name: CTC-490E21.12
  ENST ID: ENST00000601627
  CDS Start-End: 1-200
gggtggaaggccatgaaccaggctgtcgaagcattggtgccctcatggcccatgtggacgccgtcatccgccactgcgcagggcggctgggcagctatgtcatcaacgggcgcaccaagctcagggagaaatacagccctgtgttcactgtgtacatgggtcccggccagtggtggttttatgtggacacgaagcagtgaaggaagccttgatagaccaagcggatgagttcagtggccgtggagaactggcttcaataaagcaaaacttccaaggtcatggtgtagctctggccaatggagaacgatggaggattctccgacgcttctccctgaccatccttcgggacttcgggatgggaaagcagagcattaaggagcgaattcaggaggaggccagctacctactggaggagttccagaagaccaagctaagattcacgaagagattaaccaggtgattggaccacaccggctcccaagggtggatgaccgggtcaagatgccctacacagatgtcgttatccatgaaatacagagactggtagacatcgtgcccatgggtgtcccccacaa

SEQ ID NO: 122814 - DNA, 561 bp, Homo sapiens
  Payload ID: 4085
  Gene Symbol:
  Gene Name: CTC-512J12.6
  ENST ID: ENST00000588212
  CDS Start-End: 85-561
actggacgcacgctgcgggcgacattgtttgggacgctgggttctgcttttccagaatcctgccctttccaaaaggaagacggtatgattaagttccagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcact

SEQ ID NO: 122815 - DNA, 1766 bp, Homo sapiens
  Payload ID: 4086
  Gene Symbol:
  Gene Name: CTC-534A2.2
  ENST ID: ENST00000510585
  CDS Start-End: 463-1215
gggaggccgcgtattgttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgccaaacgcgaggttttccgtttccttccggggcaagttgaacctgtccagcccccgtaggctgtgggtcaaaagtgccggtcaaaatggaagtgaatccccctaaacaggagcacctgctggcgctaaaaggtcctgtttccctctgatttggcaagagagacaatcttgcaataataaattaacattctagctctgaggagttcaactaagaaattttctcatcactaagagtaactggattactgcagaatgactacagaagtaatattacattatcgaccatgtgagagtgatcccacacaactgccaaaaattgcagaaaaagcaattcaagactttcctactcgtccgctatcaagatttataccttggtttccatatgatgggtccaagcttccactcagacctaaaagatcaccacctgtgatttctgaagaggcagctgaagatgtgaaacagtacttaaccatttcagaacatgatgctaagtcacacagttatgattgcacagtagatctattggagtttcaacctagcttgaaaaagcagcatttaacctggtcacacacactgaaggaacagactaattctggaaatctgggtaaacaatcagaaaagggaaaacagcacaagaggagatcttggagtatttcccttcccagcaataattgtactaaaaacgtttctcctttgtctaaaaaattgcaagatagtttaaaggcactaaatttacactcactttatagagcaagatggacaatagaacacactatttgtaacagccaaactctggaagacatttggacaaaactcaatcaaattattaggcacaatgaacttccatcttgtaatgctacaattcagaggcatttaggccaaatatgggtgttctgtgatattatgtattgtgaatatgtgggaagtcttcttaaaggaagattagctcttactggaaaaattaatttatttgtgcataaatatggtgttatttttagtatgtaatgaattccactgattgtcaaaaagaatattctgaatgaaatgaatatggattgaaatagataaaataatttttacaggttttaaaatttttaatgactttttagaattcctaggcttgtcaattaagtcaagaaattgctgagttctgcttattggcagccttcttttaaatgtgataaattattgtttacactgaatttgaaggtaaaaatgttctgttccttttgttacaaactgtgattgaattagtcatgaattaagttgtatagtttggattttggttaatctctaaaatctaattttactgtatttttttccttacctcaagtgtaattttttaaaaaataaaactcgaaacaattctctttggagtgctatttatgtggcatgaatgtagttcaaagtgggagactagtctagatttataatgatgtttccaaagatatgtaataacaattgataggctgttttcaaacaacgatacaaaatgtatactttgcctaaaacgataatgtatcctgttttgaaggaaagtatcaaatgttgaatga

SEQ ID NO: 122816 - DNA, 332 bp, Homo sapiens
  Payload ID: 4086
  Gene Symbol:
  Gene Name: CTC-534A2.2
  ENST ID: ENST00000514404
  CDS Start-End: 319-332
gatgcctgtgttagcgagattgtctcttactgtggaactttgtaatgtttagtgatacagtgatgggacctgtaagcttaacctgagcaaatgatctagactaaaatggagattaaaatggattgttactcgtggagaagagggaaaagaagaaaagcaactaattgtcgtgttctttatctcacaatctcacttcaagtcctgtttccctctgatttggcaagagagacaatcttgcaataataaattaacattctagctctgaggagttcaactaagaaattttctcatcactaagagtaactggattactgcagaatgactacagaagt

SEQ ID NO: 122817 - DNA, 694 bp, Homo sapiens
  Payload ID: 4087
  Gene Symbol:
  Gene Name: CTC-554D6.1
  ENST ID: ENST00000520401
  CDS Start-End: 1-284
tgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaagatggctctacaaaaacaattccatggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatga

SEQ ID NO: 122818 - DNA, 3538 bp, Homo sapiens
  Payload ID: 4088
  Gene Symbol: CTDP1
  Gene Name: CTD (carboxy-terminal domain, RNA polymerase II, polypeptide A) phosphatase, subunit 1
  Uniprot ID: Q9Y5B0
  ENST ID: ENST00000075430
  CDS Start-End: 103-2706
ggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaa

SEQ ID NO: 122819 - DNA, 3380 bp, Homo sapiens
  Payload ID: 4088
  Gene Symbol: CTDP1
  Gene Name: CTD (carboxy-terminal domain, RNA polymerase II, polypeptide A) phosphatase, subunit 1
  ENST ID: ENST00000299543
  CDS Start-End: 132-2660
ggacagaaaaccccaggatggaagatccctactgaggtttcattctgttcctctgattgtacagaaagggctgctttggcctagacagagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 122820 - DNA, 3228 bp, Homo sapiens
  Payload ID: 4088
  Gene Symbol: CTDP1
  Gene Name: CTD (carboxy-terminal domain, RNA polymerase II, polypeptide A) phosphatase, subunit 1
  ENST ID: ENST00000591598
  CDS Start-End: 1-2400
gcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaa

SEQ ID NO: 122821 - DNA, 489 bp, Homo sapiens
  Payload ID: 4088
  Gene Symbol: CTDP1
  Gene Name: CTD (carboxy-terminal domain, RNA polymerase II, polypeptide A) phosphatase, subunit 1
  ENST ID: ENST00000590635
  CDS Start-End: 254-489
tcagtagctgtgctctgaccccagaaggggatatgtttccgtagcaccgaagtgtccagccatgtttgaatctacccttgtgttctgggatgggcgggcaagtggacacgcgtgtgcgcctggctctgaaaaccccaggatggaagatccctactgaggtttcattctgttcctctgattgtacagaaagggctgctttggcctagacagagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccga

SEQ ID NO: 122822 - DNA, 5866 bp, Homo sapiens
  Payload ID: 4088
  Gene Symbol: CTDP1
  Gene Name: CTD (carboxy-terminal domain, RNA polymerase II, polypeptide A) phosphatase, subunit 1
  Uniprot ID: Q9Y5B0
  ENST ID: ENST00000613122
  CDS Start-End: 148-3033
ggaagtcggcgcgggctaggcgacgggtggaagccggtaccgagaggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctcttctcgtgggtgtgtggcagcggtgagcacccgcctcctccctcgctgggatccagctccttagctgtgaaacagaaacgaaaaaattcccacggacaggaccgtgtggaacggcagaaatggaaaccgcagaactgcgagcgtgatgatctcagggtttcgcctctgagcataagaaccaggcttgtagctggtattttaaaacggttaagtgtgaagaattactctcttgcattattttcatccttcccttttgtttgtttgggatgcgggggcccgagagctacaggtaggtgctgggctatggccgccgccaggacccctcccggccagcagcctcggctcacgtcccctcctcctcccagcatcagtcccgcagcgtggcggtgggaggctgcacctcgaggccacggcccttctccaaaagcacacactcctgctttccgacggcaccctcccctgaccacagctcgggaggtggcacgtgtgagaactctccatccacaggatgtggctctcgcgggacctccaggctcaggctgtctccgctgggtgtgggacctttcctgtggggttttcgatggaggttggctggggagggaggcatcctcagtgggtagaggaccccagggtcctggtgctgctgtcgtcaagatgcggcgacatggtggcagaggaaaggcaccgttacccagcagcacgccagccccgggtgactgtttcctgtactaactaggttatttgcagcgccgagtgaagaggcagcttcaccacccaacccacctgtgggttctccggggtctgcagtctgaggaggctgcaggatgaccagacgccggtcagggagttcctcctgtccagagaagcaggaggtgaactgggcccacctcaggtccgatttcgccacgagcaagaatgtaagatgaattggacagaaaacaaaaatagatgtacaagttgatacccaaagaaagcagaagattctacagtttatagggaggggcacaaaacgtgcagggagtaatgtgccggggggtgggggcaggggccgatgaacgaggccttgatgctgtgtggagacctctgggaaaggctgggagaccttccctccttccacagtggtttctccctgaaggcgattctgcgtgtggttggtcctgctgggaccaaggtggccccttgttctgctcttggccgagtcccctctggcttcatgggggtgttaatgaggctctgcaaggcctccttaaacacagtgtggaaatacaggtggtgctgcaggggcagcgagaacggggacctctgctgctgggtctggcctaggggtgaagaggacgggaggagggtggcgtggtagctggctgcgcggggcctggtgacgggaggggccggaccgcatgcagcattcaggaccagcgtggccctgggtgttcgcctgttctgaccgtgtggtcgagtgaacagagcatgcaggggagatgcagcaggttctccccgacgcggaagagcaaggggtccccggttcctggaggagcagcgggattgccccaggctctgggatcgcccacgggggcagcgggccagcacccccagccgcatctctgcacagccgtgctgcacaccttctccgtcacgtgttggaggtgggtctcagcaccagcacatccacattgatagcttaaaatgggacttttctcccgcctgtctcactgttggcccgcccccatgcagcggtggggaccccactgcagggactccaagagccccatcctgtcctcggctccagcctccatcagcaccagccgtgtccttgcagccctgactggagcaactcccaaactctgctgcccggcaggtcttctgaccctgcccgcggtgatggcaccctctggaaggctggcccaggacggcacctccatgctggcagcccctgagtgtagtgtgtgttctacacaaaagagccaggaagtcatctgtgatcattgtttaagggactgtgattaacgtttatgaaatgttctgtgctatgcgaagaaaccactgaatgttagggaaaatattaaatactgaataattatacaactgttccaaataaagtcttaagaagaaacttg

SEQ ID NO: 122823 - DNA, 2519 bp, Homo sapiens
  Payload ID: 4088
  Gene Symbol: CTDP1
  Gene Name: CTD (carboxy-terminal domain, RNA polymerase II, polypeptide A) phosphatase, subunit 1
  ENST ID: ENST00000632932
  CDS Start-End: 103-2519
ggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcag

SEQ ID NO: 122824 - DNA, 2564 bp, Homo sapiens
  Payload ID: 4088
  Gene Symbol: CTDP1
  Gene Name: CTD (carboxy-terminal domain, RNA polymerase II, polypeptide A) phosphatase, subunit 1
  ENST ID: ENST00000632301
  CDS Start-End: 148-2564
ggaagtcggcgcgggctaggcgacgggtggaagccggtaccgagaggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcag

SEQ ID NO: 122825 - DNA, 2213 bp, Homo sapiens
  Payload ID: 4088
  Gene Symbol: CTDP1
  Gene Name: CTD (carboxy-terminal domain, RNA polymerase II, polypeptide A) phosphatase, subunit 1
  ENST ID: ENST00000632450
  CDS Start-End: 1-2213
gcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcag

SEQ ID NO: 122826 - DNA, 489 bp, Homo sapiens; identical to SEQ ID NO: 122821
  Payload ID: 4088
  Gene Symbol: CTDP1
  Gene Name: CTD (carboxy-terminal domain, RNA polymerase II, polypeptide A) phosphatase, subunit 1
  ENST ID: ENST00000632905
  CDS Start-End: 254-489

SEQ ID NO: 122827 - DNA, 2638 bp, Homo sapiens
  Payload ID: 4089
  Gene Symbol: CTDSP1
  Gene Name: CTD (carboxy-terminal domain, RNA polymerase II, polypeptide A) small phosphatase 1
  Uniprot ID: Q9GZU7
  ENST ID: ENST00000273062
  CDS Start-End: 337-1122
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaagcagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 122828 - DNA, 1109 bp, Homo sapiens
  Payload ID: 4089
  Gene Symbol: CTDSP1
  Gene Name: CTD (carboxy-terminal domain, RNA polymerase II, polypeptide A) small phosphatase 1
  Uniprot ID: Q9GZU7
  ENST ID: ENST00000443891
  CDS Start-End: 76-858
tgagattagggggcgcagccagagcaggcctaggaaaacgccagcagcgtgtggcgatcacggtgatgaagcgcaatggtggccgccccgtgggctacccaggagcaggaggagggccgagggatccagcccggggaccggggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggcc

SEQ ID NO: 122829 - DNA, 842 bp, Homo sapiens
  Payload ID: 4089
  Gene Symbol: CTDSP1
  Gene Name: CTD (carboxy-terminal domain, RNA polymerase II, polypeptide A) small phosphatase 1
  ENST ID: ENST00000428361
  CDS Start-End: 1-788
gtttgaactcagaggaggctcagagacgcggggcggggcctggcgcctttggggcgctcctgttcgctcgaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcc

SEQ ID NO: 122830 - DNA, 818 bp, Homo sapiens
  Payload ID: 4089
  Gene Symbol: CTDSP1
  Gene Name: CTD (carboxy-terminal domain, RNA polymerase II, polypeptide A) small phosphatase 1
  ENST ID: ENST00000452977
  CDS Start-End: 1-764
ctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccagccccctcactggcccgccccccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcc

SEQ ID NO: 122831 - DNA, 586 bp, Homo sapiens
  Payload ID: 4089
  Gene Symbol: CTDSP1
  Gene Name: CTD (carboxy-terminal domain, RNA polymerase II, polypeptide A) small phosphatase 1
  ENST ID: ENST00000431127
  CDS Start-End: 1-586
ggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggt

SEQ ID NO: 122832 - DNA, 4795 bp, Homo sapiens
  Payload ID: 4090
  Gene Symbol: CTDSP2
  Gene Name: CTD (carboxy-terminal domain, RNA polymerase II, polypeptide A) small phosphatase 2
  Uniprot ID: O14595
  ENST ID: ENST00000398073
  CDS Start-End: 305-1120
ccatttcctcctcttgttttcgctccggattctccatgttggacccaaactgaggagcccggagctgccgctgggggatcggggccgggggcacccgggggagccgctgcccgggccgcccgccctttgtacaggccgcctcccttcccggtccggggaggaaacgagaggggggatgtgaacagctgtggaagtcggagtctcgggagccggagcgggcccccgcccaggccccccagcccagcccagcccgcgcgcccgcccgtcctcccgcccagccagcccgggcccgcgggattgttagatggaacacggctccatcatcacccaggcgcggagggaagacgccctggtgctcaccaagcaaggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttttgagaaaagcaggtagtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccaggaa

SEQ ID NO: 122833 - DNA, 988 bp, Homo sapiens
  Payload ID: 4090
  Gene Symbol: CTDSP2
  Gene Name: CTD (carboxy-terminal domain, RNA polymerase II, polypeptide A) small phosphatase 2
  ENST ID: ENST00000547701
  CDS Start-End: 488-847
gaaaaagtgcgagttctctgtgggcagcggctggcggcccccgccttccagagcgtcaggtggaggcgcgagggggcccgcaggccctcgcgggggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttag

SEQ ID NO: 122834 - DNA, 1368 bp, Homo sapiens
  Payload ID: 4090
  Gene Symbol: CTDSP2
  Gene Name: CTD (carboxy-terminal domain, RNA polymerase II, polypeptide A) small phosphatase 2
  ENST ID: ENST00000548823
  CDS Start-End: 270-566
atgttggacccaaactgaggagcccggagctgccgctgggggatcggggccgggggcacccgggggagccgctgcccgggccgcccgccctttgtacaggccgcctcccttcccggtccggggaggaaacgagaggggggatgtgaacagctgtggaagtcggagtctcgggagccggagcgggcccccgcccaggccccccagcccagcccagcccgcgcgcccgcccgtcctcccgcccagccagcccgggcccgcgggattgttagatggaacacggctccatcatcacccaggcgcggagggaagacgccctggtgctcaccaagcaaggcctggtctccaagtcctctcctaagaagcctcgtggacgtaacatcttcaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaacaca

SEQ ID NO: 122835 - DNA, 544 bp, Homo sapiens
  Payload ID: 4090
  Gene Symbol: CTDSP2
  Gene Name: CTD (carboxy-terminal domain, RNA polymerase II, polypeptide A) small phosphatase 2
  ENST ID: ENST00000550144
  CDS Start-End: 1-544
cttcaaggcccttttctgctgttttcgcgcccagcatgttggccagtcaagttcctccactgagctcgctgcgtataaggaggaagcaaacaccattgctaagtcggatctgctccagtgtctccagtaccagttctaccaggtacgtgactctggcctgatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaag

SEQ ID NO: 122836 - DNA, 797 bp, Homo sapiens
  Payload ID: 4090
  Gene Symbol: CTDSP2
  Gene Name: CTD (carboxy-terminal domain, RNA polymerase II, polypeptide A) small phosphatase 2
  ENST ID: ENST00000549039
  CDS Start-End: 1-378
ccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctt

SEQ ID NO: 122837 - DNA, 900 bp, Homo sapiens
  Payload ID: 4090
  Gene Symbol: CTDSP2
  Gene Name: CTD (carboxy-terminal domain, RNA polymerase II, polypeptide A) small phosphatase 2
  ENST ID: ENST00000551594
  CDS Start-End: 110-418
cggagtctcgggagccggagcgggcccccgcccaggccccccagcccagcccagcccgcgcgcccgcccgtcctcccgcccagccagcccgggcccgcgggattgttagatggaacacggctccatcatcacccaggcgcggagggaagacgccctggtgctcaccaagcaaggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatctcagcaacctggcttggttttagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctg

SEQ ID NO: 122838 - DNA, 952 bp, Homo sapiens
  Payload ID: 4090
  Gene Symbol: CTDSP2
  Gene Name: CTD (carboxy-terminal domain, RNA polymerase II, polypeptide A) small phosphatase 2
  ENST ID: ENST00000622025
  CDS Start-End: 1-849
atggaacacggctccatcatcacccaggcgcggagggaagacgccctggtgctcaccaagcaaggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttggggctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctt

SEQ ID NO: 122839 - DNA, 6828 bp, Homo sapiens
  Payload ID: 4091
  Gene Symbol: CTDSPL2
  Gene Name: CTD (carboxy-terminal domain, RNA polymerase II, polypeptide A) small phosphatase like 2
  Uniprot ID: Q05D32
  ENST ID: ENST00000260327
  CDS Start-End: 564-1964
ggaaaaaccgtccttcgggtccccgcctctccactcctaacgctttactccctactccccctgcgaccactacacagccggctacggaggcccctaatgtacaaatatcccccaggcccttgctcatcctgataggttttgtcctttcttaatcgacccagtactaaggccttgtgttcagtttttctccaggattcagactagagagtttcttccggcgtaaggaacttcaacgctcttcacggaagtaaaagtgtttttttggttgttgttgccgttgtggctgcccgcattccttccctcccacctcgcggaattgtggcgggagggggaggaggaagtcagggcgcctgcgcggagaggccgctttccatccgggtccctgtccgtgcggtgcagcaggtcggtaggcgggaaatggcgactggctgaaggagctggttctgttgctgctgcggggtaagcgggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgttttttttaaaaaattatctttggccaatgactttttcatctagatcttactttcattcaaccttctaaagaagttcgtttctcattgttttgttctgtcaacttgcctgaaaaacagagacttcatctcatcaatgaagaaagcatttcattattcctacagatctttcctgcgagcacagaattcttcataaggaccagatctcttccatgtctgtgtcaatcacataaagctaaaatgtaaaggacattgaagcctttatttaattgtactaatatgatggtgttatatactacatcattagctagttaaggttttctgacctgacttctctttgtcttcctaggtatttatttgttatcttttaatcttgtgtatctaaattaacttagttaatagttacccaccgaataactatgccaagcaactagtaaagaatgtttattttatttccccttataggggaagagtggactgggaacaaaaatgtatgggccaaaaggccttagggttgtcattcattgactttcttattcctctcatgagctataattgagtatagtatttttttagtgctgatgtcattacttctcatgtcttcccctgagttgaaagcctacgacaaacatgtataaaatacatttaagaattttcagaatatgaaccacaaaactcagtatcttatatttaaatgctacttaagttattattggaatccaagtctcactaactagggtacatttttataaaatgtttctctgtatcttgaattgaaattacttgcccagaggcaagagttctggggatataacatgatttgagatcttttttaaaaaagggtggggcggcgggggagagagcgacaagtttatactagtttatgcttttgatattagtattttaagatacatcagttgatcccgaaacctgaccattagaattactctgaggagcttttaaaatagattcctggagcctacccctggaaaattgtctcgctggatctcgagaggggcctgagagttctggctttttttttttgtttggttggttttgttttgttttgttttgttttttctttaaagctctcctggtgattctaatagccagtattgggtaatcaatgttttagctaaatgtgacactggtttgagagtaggcaacaaaattaaagttcaccagacatctctttgtggtagagtttttttttttttaaactgggaccagatttcacagagcttattcaagatacatggaggaataataaagaagattaaggctactgctcattatcatttttgtctttcatattttttaagggtttgcatttctaggacttggaatagttgaccatatacatagctaaaggacatgtccctgaatgagaccattatatatattatctgtaaaatatttcactatttttttattttataaatctttgtagaaataagcaatgaaatactactttcatcttttgaaatgggatttttcaaggcagtgtccttttggcattaaggtaggggggagttaatattctctctgccttgtttccacgtgaatcaatattaaagtcatggacattttaaaatctcaatttaatttcttcttatttactatgcagtatagccgtgaacaagtaatgtagatttagttttctcatcttcaaatgccctgatcaccctacctcacagggttgttgtggggataaataaaacttttatggaagca

SEQ ID NO: 122840 - DNA, 1895 bp, Homo sapiens
  Payload ID: 4091
  Gene Symbol: CTDSPL2
  Gene Name: CTD (carboxy-terminal domain, RNA polymerase II, polypeptide A) small phosphatase like 2
  Uniprot ID: Q05D32
  ENST ID: ENST00000558966
  CDS Start-End: 126-1526
gccgccgctgcttccaatctcagtcctcctcctcttccagggccgtctgccgggatctcctccccttctaaacctggtcctccagcggctctggcgccttgttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctccaggacaggctgtggaagctgaagaaatagtaaaacaacttgatatggaacaggtggatgagatcactaccagtactactacatcaactaatggagcagcttactcaaatcaagcagttcaagtgagaccatcactaaacaatggtttagaagaagcagaagaaacagttaatcgtgatatcccaccccttacagcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtt

SEQ ID NO: 122841 - DNA, 4255 bp, Homo sapiens
  Payload ID: 4091
  Gene Symbol: CTDSPL2
  Gene Name: CTD (carboxy-terminal domain, RNA polymerase II, polypeptide A) small phosphatase like 2
  Uniprot ID: Q05D32
  ENST ID: ENST00000558373
  CDS Start-End: 13-1197
cacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatgcaccagtaactccagatagtggttattcatcagcccacgcggaggccacctatgaagaagactgggaagtatttgacccctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcaggtttatgtgagattaagaccatttttcagggaattcctggaacgaatgtctcagatgtatgagatcattctttttactgcttctaagaaggtgtatgcagacaagttactgaacatactagaccctaaaaagcaactggtcaggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactgaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaa

SEQ ID NO: 122842 - DNA, 863 bp, Homo sapiens
  Payload ID: 4091
  Gene Symbol: CTDSPL2
  Gene Name: CTD (carboxy-terminal domain, RNA polymerase II, polypeptide A) small phosphatase like 2
  ENST ID: ENST00000560620
  CDS Start-End: 1-259
ctattatttcatcaaacatgtcccgccactgacagaagaacaactaaataggaaacctgctcttccgttgaaaacaagaagcacaccggaattctccctagttttagacttggatgaaacactagtgcattgtagtctaaatgagctagaagatgcagcacttacttttccagtccttttccaagatgtcatttatcagtggtgttgtctccatctactggcaaagaagaaatatacacaagggtctgagatgatctaagagatattggagaaaccacattattaggtttatgtgagattaagaccatttttcagggaattcctggaacgaatgtctcagatgtatgagatcattctttttactgcttctaagaaggtgtatgcagacaagttactgaacatactagaccctaaaaagcaactggtcagggatagggaggctgtgtggtccactggttagagccaaggactgggagccaggaggatcctgggttccaatgcggggctaaccactgacttactgtgtgaccttgggcaagtcacttgacctccttgttcctcagtcaaccatctggaaaattggttaaaaagcaggacctcgctgacaaccagatgctgcatctgagctgagctttcttgggcaccggcttttccgtgaacattgtgtttgtgtacaaggaaactatataaaggacttaaatattcttggaagagatctttcaaaaactataataattgacaactcaccacaagcctttgcatatcagctttctaatggaatccctatagaaagttggtttatggataaaaatgacaatgaactcctaaaattgattccattcctggagaagcttgtagaactg

SEQ ID NO: 122843 - DNA, 591 bp, Homo sapiens
  Payload ID: 4091
  Gene Symbol: CTDSPL2
  Gene Name: CTD (carboxy-terminal domain, RNA polymerase II, polypeptide A) small phosphatase like 2
  ENST ID: ENST00000558791
  CDS Start-End: 96-591
gtgcggtgcagcaggtcggtaggcgggaaatggcgactggctgaaggagctggttctgttgctgctgcgggttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatcaacatgtaaaacaaaatggaaaattagaagataatccttcctctggcagtcctccaaggactactttgttggggaccatattttcacctgtcttcaactttttttcaccagcaaataaaaatggaacgtcaggatcagattctc

SEQ ID NO: 122844 - DNA, 583 bp, Homo sapiens
  Payload ID: 4091
  Gene Symbol: CTDSPL2
  Gene Name: CTD (carboxy-terminal domain, RNA polymerase II, polypeptide A) small phosphatase like 2
  ENST ID: ENST00000558968
  CDS Start-End: 307-583
agtcctcctcctcttccagggccgtctgccgggatctcctccccttctaaacctggtcctccagcggctctggcgccttggtaggcatgcactctttggcgcctcgtacgtccactgtgcggagccgctcctgtctggactttcccctgggaacagaaagggagctcacttcccgccagcttcacctcttaggttgcggcctgcgttgtgatttctggggttagatttcactttgctacccacccccactccgatctcaagttcctagtccccaacctctggttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaac

SEQ ID NO: 122845 - DNA, 575 bp, Homo sapiens
  Payload ID: 4091
  Gene Symbol: CTDSPL2
  Gene Name: CTD (carboxy-terminal domain, RNA polymerase II, polypeptide A) small phosphatase like 2
  ENST ID: ENST00000559793
  CDS Start-End: 223-575
aatctcagtcctcctcctcttccagggccgtctgccgggatctcctccccttctaaacctggtcctccagcggctctggcgccttggtaggcatgcactctttggcgcctcgtacgtccactgtgcggagccgctcctgtctggactttcccctgggaacagaaagggagctcacttcccgccagcttcacctcttagttttacatgtggcacccataaaagatgaggctgagaacacggaaagcttctcagcagtcaaatcaaatccaaacacaacgcactgccagagcaaagaggaaatattcagaggttgatgatagcctgccttcaggaggagaaaaaccatcgaagaatgaaaccggcttgttgtcttcaattaaaaaatttattaaaggaagcacacctaaggaagagagagaaaatccttcaaaacggagtagaattgaacgtgatatagataacaatttgatcacgtcaacaccaagagcaggagaaaaacctaacaaacagatatctcgagtaagacggaaaagtcaagtaaatggagaagctggtagttatgaaatgacaaatca

SEQ ID NO: 122846 - DNA, 4459 bp, Homo sapiens
  Payload ID: 4092
  Gene Symbol: CTDSPL
  Gene Name: CTD (carboxy-terminal domain, RNA polymerase II, polypeptide A) small phosphatase-like
  Uniprot ID: O15194
  ENST ID: ENST00000273179
  CDS Start-End: 27-857
gcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 122847 - DNA, 4640 bp, Homo sapiens
  Payload ID: 4092
  Gene Symbol: CTDSPL
  Gene Name: CTD (carboxy-terminal domain, RNA polymerase II, polypeptide A) small phosphatase-like
  Uniprot ID: O15194
  ENST ID: ENST00000443503
  CDS Start-End: 241-1038
cgcggctccggggttcatggtgacgaggcggcggccgctcgagcccagcggcggcggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 122848 - DNA, 368 bp, Homo sapiens
  Payload ID: 4092
  Gene Symbol: CTDSPL
  Gene Name: CTD (carboxy-terminal domain, RNA polymerase II, polypeptide A) small phosphatase-like
  ENST ID: ENST00000416688
  CDS Start-End: 1-280
taagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcagcaggcaacaggaaaatgccacaagtcacccacttatggtggactctcgggaaaaagtgtccattttcaatgccagctgctccagactgatcttatcattcctgcatcgttttctccagagaatctttagcaaatacccaccccaaaagaaaaagggggaagggtgtgagttttcggatccgcaggctgctatgaataaagatgccgtagtcagttgg

SEQ ID NO: 122849 - DNA, 793 bp, Homo sapiens
  Payload ID: 4092
  Gene Symbol: CTDSPL
  Gene Name: CTD (carboxy-terminal domain, RNA polymerase II, polypeptide A) small phosphatase-like
  ENST ID: ENST00000447745
  CDS Start-End: 1-591
gatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaatagtaatgaagccagctgccaattacatcctcccaacagcactttggtctgtggactgctgtgtgaatattcagaagggaagagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgc

SEQ ID NO: 122850 - DNA, 371 bp, Homo sapiens
  Payload ID: 4092
  Gene Symbol: CTDSPL
  Gene Name: CTD (carboxy-terminal domain, RNA polymerase II, polypeptide A) small phosphatase-like
  ENST ID: ENST00000435525
  CDS Start-End: 23-190
gcggccgccgcgccgcgcacccatggacggcccggccatcatcacccaggtgaccaaccccaaggaggacgagggccggttgccgggcgcgggcgagaaagattctctttctgagaagggcaagaagacgagtggcagaagaatcagaaagttgtctacacacctgggtggcaggtgtaaccctcgctaaagagagaaggaggacagccaggcgcggtggttcacgcctataatcccagcactttgggaggccaagcctcccagtgcaacgtcagcttaaagaagcagaggagccgcagcatccttagctccttcttctgctgcttccgtgattacaatgtggaggcccctccacccagcagccccagtgt

SEQ ID NO: 122851 - DNA, 804 bp, Homo sapiens
  Payload ID: 4092
  Gene Symbol: CTDSPL
  Gene Name: CTD (carboxy-terminal domain, RNA polymerase II, polypeptide A) small phosphatase-like
  ENST ID: ENST00000436654
  CDS Start-End: 1-311
aatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaatagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaa

SEQ ID NO: 122852 - DNA, 1549 bp, Homo sapiens
  Payload ID: 4093
  Gene Symbol: CTDNEP1
  Gene Name: CTD nuclear envelope phosphatase 1
  Uniprot ID: O95476
  ENST ID: ENST00000318988
  CDS Start-End: 469-1203
aaatggcgcctgtcagagtgggaaacccagctgcagaggctgcagccccggtccccagcggctaaaggacccccgagctcggggagggggaggccgctccggcccagcgctctgcgccctccggctccccctccccctccttccctgctccttcgctctgcaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtca

SEQ ID NO: 122853 - DNA, 741 bp, Homo sapiens
  Payload ID: 4093
  Gene Symbol: CTDNEP1
  Gene Name: CTD nuclear envelope phosphatase 1
  ENST ID: ENST00000571409
  CDS Start-End: 367-741
aacgggccgagcactcgggcgtcctcccaccattaagacctaacatagtctggaatgagaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtac

SEQ ID NO: 122854 - DNA, 1506 bp, Homo sapiens
  Payload ID: 4093
  Gene Symbol: CTDNEP1
  Gene Name: CTD nuclear envelope phosphatase 1
  Uniprot ID: O95476
  ENST ID: ENST00000574205
  CDS Start-End: 387-1121
cttcccttttcccttcctcccttttccctagccccctcccccactgccccctcccccaattatccttccccttccctccaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccag

SEQ ID NO: 122855 - DNA, 606 bp, Homo sapiens
  Payload ID: 4093
  Gene Symbol: CTDNEP1
  Gene Name: CTD nuclear envelope phosphatase 1
  ENST ID: ENST00000576613
  CDS Start-End: 1-606
cgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatg

SEQ ID NO: 122856 - DNA, 857 bp, Homo sapiens
  Payload ID: 4093
  Gene Symbol: CTDNEP1
  Gene Name: CTD nuclear envelope phosphatase 1
  ENST ID: ENST00000572043
  CDS Start-End: 376-711
cttcctcctcggggtgaaacgggccgagcactcgggcgtcctcccaccattaagacctaacatagtctggaatgagaggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactc

SEQ ID NO: 122857 - DNA, 986 bp, Homo sapiens
  Payload ID: 4093
  Gene Symbol: CTDNEP1
  Gene Name: CTD nuclear envelope phosphatase 1
  ENST ID: ENST00000570828
  CDS Start-End: 1-626
ttcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctgactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaa

SEQ ID NO: 122858 - DNA, 1708 bp, Homo sapiens
  Payload ID: 4093
  Gene Symbol: CTDNEP1
  Gene Name: CTD nuclear envelope phosphatase 1
  Uniprot ID: O95476
  ENST ID: ENST00000574322
  CDS Start-End: 380-1114
tttcccttcctcccttttccctagccccctcccccactgccccctcccccaattatccttccccttccctccaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaa

SEQ ID NO: 122859 - DNA, 876 bp, Homo sapiens
  Payload ID: 4093
  Gene Symbol: CTDNEP1
  Gene Name: CTD nuclear envelope phosphatase 1
  ENST ID: ENST00000575783
  CDS Start-End: 207-876
gtcccggtgaagcgaatacacgtcaccaccggaagtagtgtcaaaggggaagaggagggggaaagacaggaagagggagtcctttggacgcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccc

SEQ ID NO: 122860 - DNA, 506 bp, Homo sapiens
  Payload ID: 4093
  Gene Symbol: CTDNEP1
  Gene Name: CTD nuclear envelope phosphatase 1
  ENST ID: ENST00000570380
  CDS Start-End: 35-238
gggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacag

SEQ ID NO: 122861 - DNA, 1724 bp, Homo sapiens
  Payload ID: 4093
  Gene Symbol: CTDNEP1
  Gene Name: CTD nuclear envelope phosphatase 1
  Uniprot ID: O95476
  ENST ID: ENST00000573600
  CDS Start-End: 423-1157
cgccatagaccgcgcaggaggaacttagtcccggtgaagcgaatacacgtcaccaccggaagtagtgtcaaaggggaagaggagggggaaagacaggaagagggagtcctttggacggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaa

SEQ ID NO: 122862 - DNA, 579 bp, Homo sapiens
  Payload ID: 4094
  Gene Symbol: CNEP1R1
  Gene Name: CTD nuclear envelope phosphatase 1 regulatory subunit 1
  ENST ID: ENST00000389134
  CDS Start-End: 83-277
agttggcgctgcgggccgggcgggggccgcggaagctgcgatgcggacagggcagcggcggtgacccgagctgccgcccgacatgaactcgctggagcaggcggaagccccgcgagttgtatccctgattcctgcggtggtttccggtaactgccaagatctcaaggcttttgagaggagacttactgaatatattcattgtttgcaacctgctactggacgctggagaagtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctg

SEQ ID NO: 122863 - DNA, 2117 bp, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENST ID: ENST00000427478
  CDS Start-End: 111-488
ggggcagcggggagcggttagaggtgggagttggcgctgcgggccgggcgggggccgcggaagctgcgatgcggacagggcagcggcggtgacccgagctgccgcccgacatgaactcgctggagcaggcggaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttctgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtg

SEQ ID NO: 122864 - DNA, 2965 bp, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENST ID: ENST00000458059
  CDS Start-End: 907-1335
ggccaggatctctattttaacacaactattcttatttgaaatcaattacttatttgcatgtttgttgcctgctgtagcccttcctctttgcgggcaggaatcctgtctacctggctcacacgcgtatcaatacagtgtctagcatgttaggcaataaaatgattttgaatgaaagaatgccaccaataaatgaacaagaaggccttgtgatcaaatacaaatgtagtcaatcccttacagatctcttcttaagttataggtatttgggcttacactttgcctcatttaggaattatgaaagctgggtgatgtgagaggaaagtaaccaagagagaagtgtttacttaaggggttggttatctaggataccataattaaggaaactggttatttagggttctagttagttctgtacagatttcattactccttgagatccttgaggacagaaccagctctttgatttctgtatccctcgctagcgaccagaataatgcctggaaggtagtgggcgctcaatcaacatttgacgaatgaaagaaccaagcggggaacgggggataaatgaatgaacgaactggctccggagggctgcagttcctccccggggcagcaggcgacgccagcgttacgcccgcctggccgccggcagttcttggtccctccggctgaccgtccaacgctaggcgccgaggccggtgcaagagacagccaatagaaagctgtcttagttggaggtctagtagaggaatccaatgagcgtagcgggtctaggcaaggggcggtgcgacggggaggggcagcggggagcggttagaggtgggagttggcgctgcgggccgggcgggggccgcggaagctgcgatgcggacagggcagcggcggtgacccgagctgccgcccgacatgaactcgctggagcaggcggaagccccgcgagttgtatccctgattcctgcggtggtttccggtaactgccaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttctgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtga

SEQ ID NO: 122865 - DNA, 547 bp, Homo sapiens
  Payload ID: 4094
  Gene Symbol: CNEP1R1
  Gene Name: CTD nuclear envelope phosphatase 1 regulatory subunit 1
  ENST ID: ENST00000566093
  CDS Start-End: 308-547
tcagcaagttttcttatatgagaaattggaattaaagagccctaattttttgtcaagtgcttaaaaagctgtcatagtaaatgaaataaacagtgcagtgatacatggaagttagtgtgtaagacctgaagcagttaagagtatctcacatgtcgtcttaatgttaggtaaatactctgacatttcgtcagacgagtaagagtggctaattagaaaattgacatctttatacctagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgat

SEQ ID NO: 122866 - DNA, 656 bp, Homo sapiens
  Payload ID: 4094
  Gene Symbol: CNEP1R1
  Gene Name: CTD nuclear envelope phosphatase 1 regulatory subunit 1
  ENST ID: ENST00000562576
  CDS Start-End: 46-372
gcgatgcggacagggcagcggcggtgacccgagctgccgcccgacatgaactcgctggagcaggcggaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaatctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgca

SEQ ID NO: 122867 - DNA, 826 bp, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENST ID: ENST00000566482
  CDS Start-End: 53-196
ggaagctgcgatgcggacagggcagcggcggtgacccgagctgccgcccgacatgaactcgctggagcaggcggaagatctcaaggcttttgagaggagacttactgaatatattcattgtttgcaacctgctactggacgctggagaagtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatgtaagtatttttttggttagaaaattatagacctgcatgaaaacactgaaatttttggctttagaaaggtagacattttattagcaataaattttctctgtggaatgaatagtgagaatatacttagagcattgattctaaggtacttttacatttaacatctttggcattgagatccatcttacagtcaatgagatctgacaaattgggagagttgacaatttaatctttcttaatgacataaaatcatgatgcatcttataactgatgcatcttagattcagtgaagtacagtggttgtttgttattgaccaaaaatggctcagcggatattggttttataaactactgttatttatcaagtgatatgctatatatgttatttgtaaatatagagtcatagattaatttgtggactatggacatatgaacctattgtgtttttaaaagtagatgatgggagactgggcatggtggctcatgcctctaatcccagcattttgggaagctga

SEQ ID NO: 122868 - DNA, 1744 bp, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENST ID: ENST00000565457
  CDS Start-End: 37-414
acagggcagcggcggtgacccgagctgccgcccgacatgaactcgctggagcaggcggaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatata

SEQ ID NO: 122869 - DNA, 1992 bp, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENST ID: ENST00000568890
  CDS Start-End: 62-205
gggggccgcggaagctgcgatgcggacagggcagcggcggtgacccgagctgccgcccgacatgaactcgctggagcaggcggaagatctcaaggcttttgagaggagacttactgaatatattcattgtttgcaacctgctactggacgctggagaagtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttctgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcg

SEQ ID NO: 122870 - DNA, 1707 bp, Homo sapiens
  Payload ID: 4094
  Gene Symbol: CNEP1R1
  Gene Name: CTD nuclear envelope phosphatase 1 regulatory subunit 1
  ENST ID: ENST00000565556
  CDS Start-End: 254-535
agctccctgagtccccacaaacctagagggtcgacctcctcgccagcttctatttttattttcttttcactggcagacacttgcacttcgtgcattgcagcctgctaattcatttcatttcattctcacagccccgcgagttgtatccctgattcctgcggtggtttccggtaactgccaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttctgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagt

SEQ ID NO: 122871 - DNA, 542 bp, Homo sapiens
  Payload ID: 4095
  Gene Symbol:
  Gene Name: CTD-2006C1.10
  ENST ID: ENST00000547473
  CDS Start-End: 167-397
ctcttcactcctagggctgctcgcgctagttaaggtctggggctttcttgctccgagagggaccagttacttccgccgtagctgctgttgctctgtcgactgcgctgtgacctgcactgttcacgggacctttagagaggacgccagaatacctggaagccaggaaatggattcggtggcctttgaggatgtggctgtgaacttcacccaggaggagtgggctttgctggatccttcccagaaaaatctctacagggaagtgatgcaggaaaccttgaggaacctgacctccataggaaaaaaatggaacaaccagtacattgaagatgagcaccaaaatcctaggagaaacctaagatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaag

SEQ ID NO: 122872 - DNA, 567 bp, Homo sapiens
  Payload ID: 4096
  Gene Symbol:
  Gene Name: CTD-2006C1.13
  ENST ID: ENST00000591944
  CDS Start-End: 101-448
accttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatgaggcctgagtccagtgactgcaaactaaagccagtgagaaacctacaaagagaggtcattgaaagctcacaccaggcgcagtggctcacacctgtaatcccagcactttgggaggccaaggcagatggagcatctcagatgtttcaggaccctgtggcctgtgaggatgttgctgtgaacttcacccaggaggagtgggctttgctggatatttcgcagaggaaactctacagggaagtgatgctggaaactttcaggaacctgacctctataggagtctcatagaagggaatgtcaatgaaattaaagaagacagtcattgtggagaaacttttacccaggttccagatgacaggctgaacttccaggagaagaaagcttctcctgaagcaaaatcatgtgat

SEQ ID NO: 122873 - DNA, 775 bp, Homo sapiens
  Payload ID: 4096
  Gene Symbol:
  Gene Name: CTD-2006C1.13
  ENST ID: ENST00000586354
  CDS Start-End: 1-12
gcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaataggcctgagtccagtgactgcaaactaaagccagtgagaaacctacaaagagaggtcattgaaagctcacaccaggcgcagtggctcacacctgtaatcccagcactttgggaggccaaggcagatggagcatctcaggctggagtacaatggcgcgatctcaactctctgcaacttctgcctcctgagttcaagggattctcctgcctcagcctccagagtagctgggattacaggaccctgtggcctgtgaggatgttgctgtgaacttcacccaggaggagtgggctttgctggatatttcgcagaggaaactctacagggaagtgatgctggaaactttcaggaacctgacctctataggtaaggatgacaatattccttccctcagtccatt

SEQ ID NO: 122874 - DNA, 1562 bp, Homo sapiens
  Payload ID: 4096
  Gene Symbol:
  Gene Name: CTD-2006C1.13
  ENST ID: ENST00000590798
  CDS Start-End: 137-1381
acagttcatccggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgt

SEQ ID NO: 122875 - DNA, 677 bp, Homo sapiens
  Payload ID: 4096
  Gene Symbol:
  Gene Name: CTD-2006C1.13
  ENST ID: ENST00000591441
  CDS Start-End: 92-283
gctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggctggagtacaatggcgcgatctcaactctctgcaacttctgcctcctgagttcaagggattctcctgcctcagcctccagagtagctgggattacaggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagcc

SEQ ID NO: 122876 - DNA, 353 bp, Homo sapiens
  Payload ID: 4097
  Gene Symbol:
  Gene Name: CTD-2007N20.1
  ENST ID: ENST00000626108
  CDS Start-End: 1-353
atggacatgagggtccccgctcagctcctggggctcctgctgctctggctcccaggtaccagatgtgacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagtacccctcc

SEQ ID NO: 122877 - DNA, 3058 bp, Homo sapiens
  Payload ID: 4098
  Gene Symbol:
  Gene Name: CTD-2105E13.6
  ENST ID: ENST00000591954
  CDS Start-End: 1-1418
aggccccagctgtacctgctccatcccagaaggccccagccgtacctgctccatcccagaaggccccagccatacctgctccatcccggaaggcctcagctgcgtcagcttctccccgaaaggcctcagccgtacctgccccaccccagaagaccccacccccatctcagaaggccccatctgtacctaccattccccagaaggctgtgtcccccactgctccaaagaagaaatctctactcctccctgccccatcccagaaggctctgccaacctcacctaccgaataccagatggcgctgagcccgcctgcctcacgggggaagctccctggcgattttgacgtgttgccaacaggaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccaaggaggtgaccctggaggccttcaggggccaggggaagttggaggactgggcccactgggcgaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagccctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagcagccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggtcgtcttcagaaattcttttgcccatgctcttagaacttgaaactgtgaggaacacggccaccaaggcagaggagatacaggaggaatcgggcgtcttgaaccttctgcccagcctgcagcactcccagcactccgagtggccggatgcgggggcttaacctcagttggaaactgtccagaggagcccagcgctgccaggccccgagggttctgtgcgcaccgactgtaggaagcggaatgttgaaagccgcttggggggatttgccccctctggtagataccagaactatggatatgcctttatatattggggggcgggggggggcgggggcgagcccgtggagccgcccaacttcgcagagattaaagcttgagcctgagactcagcgagtcgcacctcggtgcctgtgtgcacgcgcaggcccccgagggggcgtcgggggagcaaggggtggggtgggggcgcccctaccagccccgcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctgggtgagacctgctcagccaggttatgggaggagcagggtgtgacaagggacggcagggaggggcactcccaccctaagtcccgcggagaccgttagggtgggaggccgggcggggccgggttggtgggggcggggcctggtcgagaaaaggcggggctgagcctggaggggcggggcgaggttggtaggggcgaggcctgatctggaaggtgcggggccgagtcgtgaaggtgcggggcgaggtaggtaggggcagggtctgggtaggaggagcagtgtgagggaggtaggggtcggggcctggctgggaggggcgggacggaggcctccaggggagagggaggcgggacgaagcagcgaagaactgggagggcccgagcagtggaggggcgggtcctgtcctggaatgggcgtggcttgccgcgtgacccccgcccgccacagactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgcaggtagatgcctcgcgttgacagctacgagccagcccagggtccccagttctcaacactgtcccacccagatggctccaaggccaaggagtgccgcttgacaaagccctagggttccagcctggtcctgctgagggagccgtgagaccagtcagcctggggtgctggttttcccaacgggtactccctgagctatcagccttccagaggggctcctaggagggggaagccccatcctctgactgaagcggtcctatgaggccctgttcaaccccagggttcaaaggacacaccctagatgagccatccccc

SEQ ID NO: 122878 - DNA, 670 bp, Homo sapiens
  Payload ID: 4099
  Gene Symbol:
  Gene Name: CTD-2116N17.1
  ENST ID: ENST00000635704
  CDS Start-End: 46-192
tgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttata

SEQ ID NO: 122879 - DNA, 1033 bp, Homo sapiens
  Payload ID: 4099
  Gene Symbol:
  Gene Name: CTD-2116N17.1
  ENST ID: ENST00000634318
  CDS Start-End: 50-400
cggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaagttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactc

SEQ ID NO: 122880 - DNA, 726 bp, Homo sapiens
  Payload ID: 4099
  Gene Symbol:
  Gene Name: CTD-2116N17.1
  ENST ID: ENST00000558783
  CDS Start-End: 1-58
ccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaacagtgccctacagcctacagccggtctccttgtggtcttgcttgcccttctacatctctaccattaagaggcaggtcaagaaacagctacagttctccaacccatacactaaaaccgaatccaaatggtgcctagaagttcaatgtggcaaggaaaaaaaccaggtcttcatcaaatctactaatttcactccttattaacagagaaacgcttgagagtctcaaactggactggtttaaagagcatctgaaggatttgactagatgataaatgccaatattaaatctgttggagtttcacgtataagacagaggagaaagagaacatcaaaaattacttagcaagctatggaatggagattcagttttcattttagtttgttaaatctacaaggctgtaaaatgattaggttacaagatgttcacctaagattgagacctagtgactacatttcctacgggaacaaataaatggtttttcatctcccggagatacattacaaacaaatatggtgctaaaagaactc

SEQ ID NO: 122881 - DNA, 757 bp, Homo sapiens
  Payload ID: 4099
  Gene Symbol:
  Gene Name: CTD-2116N17.1
  ENST ID: ENST00000635605
  CDS Start-End: 46-243
tgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagagcatgtcctttgcaacctgatcacacaaatgatgaaaaagaatagaactttctcattcatctttgaataacgtctccttgtttaccctggtattctagaatgttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttag

SEQ ID NO: 122882 - DNA, 920 bp, Homo sapiens
  Payload ID: 4099
  Gene Symbol:
  Gene Name: CTD-2116N17.1
  ENST ID: ENST00000635511
  CDS Start-End: 46-381
tgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttag

SEQ ID NO: 122883 - DNA, 646 bp, Homo sapiens
  Payload ID: 4100
  Gene Symbol:
  Gene Name: CTD-2132N18.3
  ENST ID: ENST00000585562
  CDS Start-End: 1-84
gcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccc

SEQ ID NO: 122884 - DNA, 694 bp, Homo sapiens
  Payload ID: 4100
  Gene Symbol:
  Gene Name: CTD-2132N18.3
  ENST ID: ENST00000592248
  CDS Start-End: 63-548
cctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccagctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagggtgtgctgaactttgtgcagtacaagtttagtcacctggctccc

SEQ ID NO: 122885 - DNA, 958 bp, Homo sapiens
  Payload ID: 4100
  Gene Symbol:
  Gene Name: CTD-2132N18.3
  ENST ID: ENST00000592574
  CDS Start-End: 113-958
taacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccc

SEQ ID NO: 122886 - DNA, 1753 bp, Homo sapiens
  Payload ID: 4101
  Gene Symbol:
  Gene Name: CTD-2135J3.4
  ENST ID: ENST00000554914
  CDS Start-End: 92-1414
tacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaaggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatag

SEQ ID NO: 122887 - DNA, 1374 bp, Homo sapiens
  Payload ID: 4102
  Gene Symbol:
  Gene Name: CTD-2140B24.4
  ENST ID: ENST00000540096
  CDS Start-End: 91-1167
ggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttca

SEQ ID NO: 122888 - DNA, 4505 bp, Homo sapiens
  Payload ID: 4103
  Gene Symbol:
  Gene Name: CTD-2192J16.17
  ENST ID: ENST00000428311
  CDS Start-End: 143-2068
gtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggactcagtggtctttgaggatgtggctgtgaacttcacccaggaggagtgggctttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaaggtagtcagtttggagaaaccatcagtcagactccaaatcctaaaccaaacaagaaaacttttactagagtaaaaccatatgaatgtagtgtgtgtggaaaggactatatgtgtcattcatctcttaataggcacatgagatctcatactgaacatagatcatatgaatatcacaaatatggagagaaatcatatgaatgtaaggaatgtgggaaaagattcagctttcgaagttcatttcgaatacatgaaagaactcacactggagagaaaccctataaatgtaaacagtgtggtaaggctttcagttggcccagttcctttcaaatacatgaaagaactcatactggagagaaaccttatgaatgtaaggaatgtgggaaggccttcatttatcacacaacctttcgaggacacatgagaatgcacacaggggagaaaccctataaatgtaaagaatgcgggaaaacgttcagtcatcccagttcttttcgaaatcatgaaagaactcactctggagagaaaccctatgaatgtaaacaatgtggaaaagctttcagatattaccaaacttttcaaatacatgaaaggactcacactggggaaaaaccctatcagtgtaagcaatgtggtaaagctcttagttgtcccacatcctttcgaagtcatgaaaggattcacactggagaaaaaccctataaatgtaaaaaatgtgggaaagccttcagttttcctagttcctttagaaaacatgaaagaattcatacaggagagaaaccctatgattgtaaggaatgtgggaaagcattcatttctcttccaagctatcgaagacatatgataatgcacactggaaatggaccttataaatgcaaggaatgtgggaaagcctttgattgtcctagttcttttcaaatccatgaacgaactcacactggagagaaaccctatgaatgtaaacagtgtggtaaagccttcagttgttccagttcctttcgaatgcatgaaagaactcacactggagagaaaccccatgaatgtaaacaatgtggtaaagccttcagttgttccagttctgttcgaatacatgaaaggactcacactggagagaaaccctatgaatgtaaacagtgtggtaaagccttcagttgttccagttcctttcgaatgcatgaaagaattcacactggagagaaaccctatgaatgtaaacagtgtggtaaagcctttagtttttctagttcctttcggatgcatgaaaggactcacactggagagaaaccctatgaatgtaaacaatgtggtaaagccttcagttgttccagttcctttcgaatgcatgaaaggactcacactggggagaaaccctatgaatgtaaacagtgtggtaaggcgtttagttgttccagttccattcgaatacatgaaaggactcacactggagagaaaccttatgagtgtaaacaatgtggtaaggccttcagttgttctagttctgttcgaatgcatgaaaggactcacactggagtgaaaccctatgaatgtaaacaatgtgacaaagccttcagttgctcacgttcctttcgaatccatgaacgaactcacactggagagaaaccctatgcatgtcaacaatgtggtaaagccttcaagtgttcccgttcctttcgaatacatgaaagagttcatagtggagagtaaccctatgtatataagcaatatggcaaagttttcagttgtcctatttcctttttttttttttttttttttgagttgaattctcactctgttgccctggctggagtgcagtagagtgatctcagctcactgcaacctctgtctcctgggttcaagcgattctcctgcctcagcttcctgagtagctgggacaacaggtgtgaacgaccatgcccacttaatttttgtatttttagtagagatggggtttcgccatgttggccaggctggtctcgaactcctgacctcagacgatccacctgccttggcctcccaaagtgttggattacaggtgtgagccaccacacccggcccccatttccttttgaagacatgaaattattcatatttcagagaaaccctataagacatgggaataccttcagttatttacatgtgaatatgaggaagcattcatactggacaggaaaccctgcgaatgtaggcagtgtgggaaaaccttcaatggtcatatgaccttttaaggaccatgagaaggcatatgaagtgtaaagaattttcatatgccctataaatgtaaagaatttataaccttaaaaatgtaaagaatgtggaaaaccctataaatgtaaaaaatgtagaaaaacctttatttgtcttagtttacttggaaaccatgaacaaactcacactggaaagcgacttcttaaatatagacattgtgagaaagccttcagttggcccacatactaatatgtgagaatgcagactggatagaaatcctataaaagtgagatatagcaatgttttccattttaacaaatgctcatgtgatactcccttatgtgtgaaacttcaatctcatgttgaaactcccactagggaggtactgtataaatgtagataatatgggaaagcctgatgcaaattaattcatgtatattgttctagaaaattcacaacatgtcagaaatgtgataaaacatattatcagttactgattcttaaaatggatctctgaattatggatttctattactttcacaaaagaacactgagatgagataattctgtaagctcttatacagttgtacacaagttgaattgatagtattttttcattaaatcagtttctgaaattttgtctttccatattgaagtctgttagattcatgagtgaattgaagtgtatttataataagctagcagttttgatttttatgtattttttagttgtgctgtaatgggccatcaaaaaatgacaatttggtaatttttaggatttcctactggccttatgtggcaggtactagatatcattatatgtatttcatctttctgaccaaaagaggcttttttagaggaagacagagtacccttttttctattttttatgctaaaaaataatcataataaatttttgagtctgcaaagtttatcatacagtatactctctcattggaattattattttcatcttctgtttgctgtttgtaattccttctggctgtgatttgaataatagactttgtattaataagagagatctgagatagaaccatataacctatagctggaaatggctgtcctggattgtgttaacatgggttatgttgtgacctatgttttctataatctaaccttttatggctccacggtataattcaccaatagcctacttgcaggagatatggaaggcagaagtgaagaaagcattagtcaggttttatagccaccatatgtggagacagatggatgcataggagcttcagggacacctgcttccaccacattgtcctgatcctttgctctgccaattgagagtattcttagaaccaccactaactgcttgactgccatattttccttccttccttccttctttctttccctttccctttcttttctttctttactttctttttccgagatggagtcttgctctgtcgcccaggctggagtgcagtggtacgatcttggctcactgcaacctctgccttctgggttcaagcaattgtcctgccccagcctcccaagtagctgggattataggtgcccaccaccaagcccagctaaattttttttgtatttttagtagagacagggtttcatcattgttggccaggctggtctcaaactcctgacctcatgatctgcccaccttggccttccaaagtgctgagattacaggcgtgagccactgtgcatggccccagctgccatattttcaaagatgtagttttccacaaattgtcttcaaaagttctactcaaagatgcactgcagtttggattttcctagaaactctaatgtgtccaccaggcaaccatttagactcttaaggttgggaatattctctgatgctctgactcacctcatctctaggttgaatttatccaaggtattatttatgtaataaacaccatgttttgttaacagt

SEQ ID NO: 122889 - DNA, 5857 bp, Homo sapiens
  Payload ID: 4104
  Gene Symbol:
  Gene Name: CTD-2192J16.20
  ENST ID: ENST00000593682
  CDS Start-End: 1-491
gtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctcccggattcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccacgcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccaccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctggagcctccgaattctccgttttctgaattgcataggcacgataggggtcgggtctgtcctttgttggagtcagtccccccttttcttagcaagtcagtgtgttttagaagggaggtggcagcattgagggaaaccaggtcaccatccaccctcgtaacaacagtctccctgggtgggtcccagaagtgatctttgtgtcgctcgggtcggaactctttaggcctctggcctccaccctcccccaacagcagggatgggtcaggtggcagcatccaaaaccacggtgaagatactagggtccagaggccgactggagcaaggtttgctggcagatgaggcctcagtggaagtgacggctactgtggagatgcagtggaggacctggtggctgagccaggagatgcacaccttcgcttctctcaccaggaacattcgcttctctcaccaggaacatttatggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgattaattaa

SEQ ID NO: 122890 - DNA, 838 bp, Homo sapiens
  Payload ID: 4105
  Gene Symbol:
  Gene Name: CTD-2192J16.22
  ENST ID: ENST00000597692
  CDS Start-End: 1-595
ccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggacctgttctccaccttcaccatcacccgcctgcaggagaccacgctggtggccaaccagctccgcgaggcagcctccaggctcaagtggacaacaaacacaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagttgtgccactgaagatcctggtgtcgccatgggccgccgccccgcccgttgttaccggtattgtaagaacaagccgtacccaaagtctcgcttctgccgaggtgtccctgatgccaa

SEQ ID NO: 122891 - DNA, 585 bp, Homo sapiens
  Payload ID: 4106
  Gene Symbol:
  Gene Name: CTD-2192J16.24
  ENST ID: ENST00000597961
  CDS Start-End: 1-585
actaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagacatgccccacagtgcagccgaacatgctgaacgtgcacctgctgcctcacacacatgatgacgtgggctggctcaaaaccgtggaccagtacttttatggaatcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccaggggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttc

SEQ ID NO: 122892 - DNA, 942 bp, Homo sapiens
  Payload ID: 4107
  Gene Symbol:
  Gene Name: CTD-2207O23.10
  ENST ID: ENST00000601870
  CDS Start-End: 1-91
tccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgggccgtgcctgcggagccgggcggaacgctagcggtgttggcgcggagtggaccccggctgcggcccctgggtgtttccacaccggtagccagctgtgccctgaggtggaagaggaccggccacccaggaattttccaacaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgg

SEQ ID NO: 122893 - DNA, 382 bp, Homo sapiens
  Payload ID: 4108
  Gene Symbol:
  Gene Name: CTD-2207O23.12
  ENST ID: ENST00000599312
  CDS Start-End: 1-144
aagatgctgaagccacacagaacacctccggccccggtgactgaagagatgctacagcgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcga

SEQ ID NO: 122894 - DNA, 4964 bp, Homo sapiens
  Payload ID: 4109
  Gene Symbol:
  Gene Name: CTD-2207O23.3
  ENST ID: ENST00000617428
  CDS Start-End: 1-3367
taccagtgtgaagcgcaggctgagctgcctccgcagtcgagtgaccaggcagaaggagaaggggaagagcccagcacatctgaaggacaagggccaggatgcacgagagaggcgggagtgtgtcaatgggcaccagctgttgcaagggaccttctccggcccctccagctgccccctgtgtggcaaacctttcttgagctcagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcagctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccgggcccccagctccctcgccactgccggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatg

SEQ ID NO: 122895 - DNA, 1207 bp, Homo sapiens
  Payload ID: 4110
  Gene Symbol:
  Gene Name: CTD-2278I10.6
  ENST ID: ENST00000596542
  CDS Start-End: 124-450
tcccaggaggcgtcggggctgcgccgtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcg

SEQ ID NO: 122896 - DNA, 420 bp, Homo sapiens
  Payload ID: 4111
  Gene Symbol:
  Gene Name: CTD-2287O16.3
  ENST ID: ENST00000600981
  CDS Start-End: 179-420
gtatggaacacaatcattgattaatctaatatatacaatagggagaaccgtaactacagatttacagattgtggagcaacaaatagagcggcagttaaaatgcttggcatttcgaaaccctggaccacaggtagcagactttaatcctgaaacaaggcagcagaaaaagaaagcccggatgtcaaagatgaatgaatatttttctaccaaatacaaaataatgaggaagtatgacaaaagtggcaggctcatctgtaatgacgctgatctgtgtgattgtctagagaagaactgcctgggctgcttctacccatgcccgaagtgtaactccaacaagtgtgggcccgagtgccgctgcaaccgacggtgggtttacgatgccatcgtcactgagtcaggagaggtcatcagcacgctgcc

SEQ ID NO: 122897 - DNA, 213 bp, Homo sapiens
  Payload ID: 4112
  Gene Symbol:
  Gene Name: CTD-2313N18.7
  ENST ID: ENST00000530210
  CDS Start-End: 1-213
atgagggtcttgttttttgtctttggagtcctttccttgatgtccacagttcctccaaccagaagcttcacttctaatgatgaatgtccttcagaatattatcattgcagactgaagtgcaatgctgatgaacatgcaattagatactgtgctgacttcagcatctgctgcaaactgaagatcattcaaattgatggacaaaagaagtggtga

SEQ ID NO: 122898 - DNA, 1966 bp, Homo sapiens
  Payload ID: 4113
  Gene Symbol:
  Gene Name: CTD-2331H12.8
  ENST ID: ENST00000634278
  CDS Start-End: 504-1966
cggcccctcttttctcaacccagagcaaattgaaacgtccgggctggagtgcaatggcgcgatcttggctcaccacaacctccgcctcctgggttcaagtgatctcctgcctcagcctccccagtagccgggattacagtagagacaaggtttcaccatattggccagactgttctctgaactcgacctcaagtgatccacccacctcggcctcccagagtcctgggattacaggctggagggcagttgtgcgatcttgattcacttcaacctctgctctccgggctcaagcaattctcccacctcagcctgagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacattgtcatcaacagggcaaggcaatacagaagtgatccacacagggacattgcagagacaagcaagttatcacattggagcattttgctcccaggaaattgagaaagacattcatgactttgtgtttcagtggcaagaagatgaaacaaatgaccatgaagcacccatgacagaaataaaaaagttgactagtagtacagaccgatatgatcaaaggcatgctggaaacaagcctattaaaggtcagcttgaatcaagatttcatttgcatttgcgaagacataggagaattcatactggagagaaaccttacaaatgtgaagaatgtgagaaagttttcagttgcaaatcacatcttgaaatacataggataattcatactggagagaaaccatacaaatgtaaggtttgcgacaaggcttttaagcatgattcacacctggcaaaacatactagaattcacaggggagacaaacattacacatgtaatgaatgtggcaaggtttttgatcaaaaagcaacccttgcatgtcatcatagaagtcatactggagagaaaccttataagtgtaatgagtgtggcaagacctttagtcagacatcacaccttgtgtaccatcatagactgcatactggagagaaaccttacaaatgtaatgagtgtggcaagaccttcgctcgaaattcagtcctcgtaattcataaggcagttcatactgcagagaaaccctataagtgtaatgaatgtggcaaggtttttaagcaacgagcaactcttgcaggacatcgtagagttcacactggagagaaaccttacagatgtgaagaatgcgacaaagttttcagtcgcaaatcacatcttgaaagacataggaggattcatactggagagaaaccatacaaatgtaaggtttgtgacaaggctttccggagtgattcacgtcttgcagaacatcagagagttcatactggagagagaccttacacatgtaatgaatgtggcaaggtttttagtacaaaagcgtacctcgcatgtcatcaaaaacttcatactggagagaaactttacgaatgtgaagaatgtgacaaagtttacattcgcaaatcacaccttgaaagacataggaggattcatacaggagagaaacctcacaagtgtggtgattgtggtaaagcctttaattcaccttcacaccttattaggcatcagagaatccatactggacagaaatcttacaaatgtcatcagtgtggcaaggtctttagtctgaggtcactccttgcagaacatca

SEQ ID NO: 122899 - DNA, 809 bp, Homo sapiens
  Payload ID: 4114
  Gene Symbol:
  Gene Name: CTD-2349B8.1
  ENST ID: ENST00000564808
  CDS Start-End: 1-314
ggcatttcctccccgctagctggcgcggcctcgcctccccctcggaagaggaaactcccggggtccgagtaacagggtcaggcgcggagaggagcggcgggagagccaggagggccgcccaggctatgtcctcctgcgctgtcgccacgctgtccggcagcgcttcctgcccgggtctccccgtctggagggtcacgccgccttctcctcgagacacttccgagagccgggcctcagcatcctgctggagagttactacgagcatgaggtgcgcctgtctccgcacgtgttgggccacagcaaggcgcacgtgagccggatcgtgggcgagctggtgcgggctggccgcgcccgggggtcccccggtctcattcctgggggagcgctggccttggccttccgcggagacttcatccagggtctcagtctgttgcccaggctggagtgcagtggcaagattgcagctcattgcagccttgacctcctgggctcaagcgatcctcctgcctcggcctcccaactagctgggaccacaggttccttggaagagtcaaaaagtaaaatggagaaactgagaagtgttatctaaatgtcgactgtgttcttttaggaatgcaccagcatttctggaaccacaggaagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggct

SEQ ID NO: 122900 - DNA, 365 bp, Homo sapiens
  Payload ID: 4114
  Gene Symbol:
  Gene Name: CTD-2349B8.1
  ENST ID: ENST00000568526
  CDS Start-End: 1-229
ccggggtccgagtaacagggtcaggcgcggagaggagcggcgggagagccaggagggccgcccaggctatgtcctcctgcgctgtcgccacgctgtccggcagcgcttcctgcccgggtctccccgtctggagggtcacgccgccttctcctcgagacacttccgagagccgggcctcagcatcctgctggagagttactacgagcatgagtctgactctgttacctaggctggagtacagtggtggcaccatagctcactgcagccttcaactcccaggctcaagccatcctcctgcctcagcccccgattggaaccattaaacgagggttttctttctagaatctctggtctgctgctgtgca

SEQ ID NO: 122901 - DNA, 1956 bp, Homo sapiens
  Payload ID: 4115
  Gene Symbol:
  Gene Name: CTD-2369P2.10
  ENST ID: ENST00000452032
  CDS Start-End: 5-442
cgtgatgcatgtcatggccgcctccatggcccggggaggcgtgagtgccagggttctactgcaggctgccaggggcacctggtggaacagacctgggggcacttccgggtcgggggagggggtggcgctggggacaaccagaaagtttcaagcgacaggctcgcgcccggctggagaggaggacgcgggcggcccggagcggcccggggacgtggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccagcaaagcttctggcgccgccctgtctgaacctggagcggctgggaggatccccctcccaggagaagccgaggaccccaggatgctgcagaatcagtgagaggtccctctggcctgcatgccaggagtcggtcaccgccctgtgcttcctccaagagacagtggagaggctggggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctg

SEQ ID NO: 122902 - DNA, 1850 bp, Homo sapiens
  Payload ID: 4116
  Gene Symbol:
  Gene Name: CTD-2369P2.12
  ENST ID: ENST00000586529
  CDS Start-End: 1-474
agctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgccctaagcaaacatctgcgcttatgttccattgattatgggctttccctcgcctccctggcgcggcgcatgctcagtcggctcgcgcccggctggagaggaggacgcgggcggcccggagcggcccggggacgtggtgaacgtggtgttcgtagac

SEQ ID NO: 122903 - DNA, 760 bp, Homo sapiens
  Payload ID: 4117
  Gene Symbol:
  Gene Name: CTD-2370N5.3
  ENST ID: ENST00000578021
  CDS Start-End: 1-371
tctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagatagccaaatcaccaaaatgtccagttagaacaagaatttagcattctgcaaaagaagttaacagctgagggccatttatcatcactgtgtaccaagtggtagaggagtaagcaatgatatgctgtttagatatgctgaaaagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttct

SEQ ID NO: 122904 - DNA, 608 bp, Homo sapiens
  Payload ID: 4117
  Gene Symbol:
  Gene Name: CTD-2370N5.3
  ENST ID: ENST00000584948
  CDS Start-End: 1-353
tctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagatagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgt

SEQ ID NO: 122905 - DNA, 1008 bp, Homo sapiens
  Payload ID: 4117
  Gene Symbol:
  Gene Name: CTD-2370N5.3
  ENST ID: ENST00000578584
  CDS Start-End: 47-562
aaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagatagccaaatcaccaaaatgtccagttagaacaagaatttagcattctgcaaaagaagttaacagctgagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgta

SEQ ID NO: 122906 - DNA, 879 bp, Homo sapiens
  Payload ID: 4117
  Gene Symbol:
  Gene Name: CTD-2370N5.3
  ENST ID: ENST00000581884
  CDS Start-End: 1-460
ctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagatagaggaggaaacggtgactcagaagtgcagagtcttgcctaaggtcatacaagtaaacagaacacatcactcacttcttatgagaagaaatctcactaaactatttcagtttgctagaggaacattttaaatctgaattgaaccacccattttcctttcttagccaaatcaccaaaatgtccagttagaacaagaatttagcattctgcaaaagaagttaacagctgagggccatttatcatcactgtgtaccaagtggtagaggagtaagcaatgatatgctgtttagatatgctgaaaagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaag

SEQ ID NO: 122907 - DNA, 483 bp, Homo sapiens
  Payload ID: 4118
  Gene Symbol:
  Gene Name: CTD-2410N18.5
  ENST ID: ENST00000519718
  CDS Start-End: 211-483
agagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaag

SEQ ID NO: 122908 - DNA, 4862 bp, Homo sapiens
  Payload ID: 4119
  Gene Symbol:
  Gene Name: CTD-2501B8.1
  ENST ID: ENST00000577647
  CDS Start-End: 46-2265
attggccaggggacggtagctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgatgacttctacaatgagaccgagaccaagatcttcctgcagttttatgaccaaacagggatttgggaccatggggcaccacatctcctgcccccatcccaagcaagaggaacaagggaagccccagtgtacatgtcaaagagggctgcaagctctgggcctcctggaagccctaaacttcctccagctgcacaaggacatggagaggtcccagttcatgatttactttggcacccaggcccacctgtttaaagtcacccagttcaaggacccggatgtgaatggcatgctgaaactcgaagtcatggccacctccagggacaaagaggagctgctgtgggcctggcagggctggcaggatgccgtgggccgccagatctgcaccaccttcgagcactatgtggagctcagcaacaaggctgcacagctcaacggaagaggctgctgagaaagagaatgagaagaggctgctgcagacaagtggacagggaaggcctctgacatttatccaagacctgaaagatgggcaaaagacgggaagcaagatgtgaaagaagagcagcctaggcagaggctccgcggcaggaggagccggtgctctggaagacctgaaagaagcccaggttacaaagacatgggggccttgtggcactccaagtatgagtcggataccctggagcaagacctggagcggctattccaggagctgcggccactctacctgaacctgcacacctacgtgcgcagggccctccaccgccactatgggcccgagctcatcgacctgagggggcccatccctgcccacctcctggagaacacgttggctcagtcctgggtcaacatcttagacccggtcctgcccttcctgaagaagatcccagaggatgtcacaaagatcatgaaagtccagcactggaagccagagaaaatgttggaagaggctgagacattcttcacctccttggcgctgccacctgccccacccagtttctggaaaaagttgatgctaatgaggccaaccgatgggcgagaggtggagtgtcacatctctgcctggaacttctaccaggacgacgatttcagctaggaggctgaggcaggagaatcactggaacctgggagccggaggctgcagtgagccaagatcgcaccattgcactccagctgggagacacagcaagactccgtctcaaaagaaaaaaaaaaaaaagaacaactgccaagaataaagaagtgcgcggaagtgaccacagaagacccgctctccatcttccacgaaatgggccattccagtacttcctgcagtacaagaacctctccatcatcttccgcgcaggtgccaacccagcctttgaagaggctgtggggtctgtgatcaccctctcggcctcctcccacaagcacctgctcaacataggcctgctcagcctctagcaccaggactcagaggatgaggtcaatttcctgatgcatattgccctggagaagatcgccttcatcccctttggctacctgatggacctccttcgctggaaggtctttgacggcaccatctggaaggacatctacaatcaggagtggtggaacctcaggttgaaataccagggcttgtgccccgctattcctcactcagaggaagactttgatccaggtgccaagttccacttttctgcaggtacttcctcagtctggtgctccagttccagttccacgaaacactgtgcaaagcctcgggccacatgggtccactgcaccagtgtgacatctacaactccaagattgccgggaagctcctgggggatgctctaaagctgggctcaagcaagccctggccagaggtcctaaagatgctgactggggagtctgaggtgtctacaaatgtcttcatgacctacttcaaacccctactgacctggctggtgacagaacatgcagcaaggggacatcttaggctggccagacttcagctgttcctttgaagaaaaagacacagacaaagtgacattcctgagtctgaagctggaccccaaccaggctaaatttgggtactgggtgctgttggccctgggctttgtcatgtctctggtggtgctggggctggcctgcaggctgcagtccctggaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcacacagtaaagcaggaagcctccaaggtaacccggctatgggactgcagtgcccaaggaatttctgctctggttagaaaaaggactctgcttcagtccacttctgctctggttagaaaaaggactctgcttcagtccacagtacataaaatgtactcagctatcagctctataagagctggatgcacatcaggagtgtgcccctctgtaacaactctagtcagcacaggccatggtgcacaaaagggacttggaaaatgatggaatgaccagcctgtccaacagaggggcagccaggacatctctgccctcttctcatcccccagccacagtggccaaagaggcccccactaggcactgtggctctgcatgacaaacacacatccagcccaggactctaagcctctcacctggactccagtaaaaaccttgctgagcctccttgtctatccttcctcccccacccaccattgtaaagtttatgtcaccagaatatttctttcatgtctaattgcttaagaacttggttgttcatcaattaaatctagatgttcaaaa

SEQ ID NO: 122909 - DNA, 557 bp, Homo sapiens
  Payload ID: 4120
  Gene Symbol:
  Gene Name: CTD-2510F5.6
  ENST ID: ENST00000577660
  CDS Start-End: 1-333
gatctgcggaaactgcttagaaaagtcgatgtagagaggagcccaggtggaacccctcttaccaataaggaaaatatggaaacaggaacaggactgactccagtgatgacgcaggccttaaggagaaagtttcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaa

SEQ ID NO: 122910 - DNA, 892 bp, Homo sapiens
  Payload ID: 4121
  Gene Symbol:
  Gene Name: CTD-2521M24.10
  ENST ID: ENST00000594663
  CDS Start-End: 215-892
ggaggctgaggtcagtcgcaggctggagaaccggctggtgctgctgttctttggtgctggggcttgtccacagtgccaggccttcgtgcccatcctcaaggacttcttcgtgcggctcacagatgagttctatgtactgcgggcggctcagctggccctggtgtacgtgtcccaggactccacggaggagcagcaggacctgttcctcaaggacatgccaaagaaatggcttttcctgccctttgaggatgatctgaggagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtctgactggtttctctacgactgccgcctcctcagacatgtggcccttggccttttctgctgtgggatctccgtctatttagcagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggacccctttgggtccatggccactgccacagcacctgcagcc

SEQ ID NO: 122911 - DNA, 572 bp, Homo sapiens
  Payload ID: 4122
  Gene Symbol:
  Gene Name: CTD-2528L19.4
  ENST ID: ENST00000585547
  CDS Start-End: 234-428
attgacccttggctccaggttccctgctgcttcctgtgccttcctcagcctagtacgactacaacagagaaatggtcccaatgggaaatcagatactgagtcttagatgaagatttccagtgagaagaaacagataggatgagaagcttagaagagtaattgcccttaagaaaggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtggaacacaacagatttgagaagcctcggattaaggaataatttatgaagctccgttgactaccgtggagagatcataatttggggttcaagattccaggccttttggttaagggaaactcaacctgtaatagctgctgcaatggggaagtgaactgaactggactggagtgcagtggcatgatctcggctc

SEQ ID NO: 122912 - DNA, 380 bp, Homo sapiens
  Payload ID: 4122
  Gene Symbol:
  Gene Name: CTD-2528L19.4
  ENST ID: ENST00000591114
  CDS Start-End: 150-269
acagagaaatggtcccaatgggaaatcagatactgagtcttagatgaagatttccagtgagaagaaacagataggatgagaagcttagaagagtaattgcccttaagaaagatttggattcaagatgtgaaataatcagcgatgggaaaatgcagctttataggaaacactcatgtgttactctccatcagagaattcataatggacagaaaccatatgagtggaacacaacagatttgagaagcctcggattaaggaataatttatgaagctccgttgactaccgtggagagatcataatttggggttcaagattccagggaaactcaacctgtaatagctgctgcaatggggaagtgaactgaactggactggagtgc

SEQ ID NO: 122913 - DNA, 704 bp, Homo sapiens
  Payload ID: 4122
  Gene Symbol:
  Gene Name: CTD-2528L19.4
  ENST ID: ENST00000586606
  CDS Start-End: 186-578
acagagaaatggtcccaatgggaaatcagatactgagtcttagatgaagatttccagtgagaagaaacagataggatgagaagcttagaagagtaattgcccttaagaaaggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattggcaggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtggaacacaacagatttgagaagcctcggattaaggaataatttatgaagctccgttgactaccgtggagagatcataatttggggttcaagattccaggccttttggttaagggaaactcaacctgtaatagctgctgcaatggggaagtgaactgaactggactggagtgca

SEQ ID NO: 122914 - DNA, 1616 bp, Homo sapiens
  Payload ID: 4123
  Gene Symbol:
  Gene Name: CTD-2535L24.2
  ENST ID: ENST00000577662
  CDS Start-End: 1-139
attgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggtaatgcggcctaggccttcttcctgcttccgtccacggcgtgagcgctcgtatgtgtatgcgcatgtgcatggggtgcgttagggtgtgcgcatgtgcgt

SEQ ID NO: 122915 - DNA, 776 bp, Homo sapiens
  Payload ID: 4124
  Gene Symbol:
  Gene Name: CTD-2545G14.7
  ENST ID: ENST00000570760
  CDS Start-End: 1-89
acaatgccatccccatcaaatcctggttcagtgaccccagcgacacagcccttctcaacctgctcccaatgctggatgccctcaggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccacc

SEQ ID NO: 122916 - DNA, 1265 bp, Homo sapiens
  Payload ID: 4125
  Gene Symbol:
  Gene Name: CTD-2545M3.6
  ENST ID: ENST00000599632
  CDS Start-End: 1-1192
gggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccaggctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaa

SEQ ID NO: 122917 - DNA, 472 bp, Homo sapiens
  Payload ID: 4126
  Gene Symbol:
  Gene Name: CTD-2561J22.3
  ENST ID: ENST00000600810
  CDS Start-End: 1-279
gaattctctctggaggagtggcaatgcctggacactgctcagcaggatttgtataggaaagtgatgttagagaactacagaaacctggtcttcttggcaggtattgctgtctctaagccagatctggtcacctgtctggagcaaggaaaagatccctggaatatgaagggacacagtacggtagtcaaacccccaggaggggattgtagcatattcctaatggagcaccaaggtgatgtgacactgctgcctggtccctgccctcagagaagattgtgacatatcactgccccgaaacccaggtgtgattgttacatacacctctgcccagcacctgagtgatttgactcttctgcttgggcccagcgtacagatgggattgtgccgcattgctggacccagcacttaggtgatgacagaattgtaacatatccctggctgagcactcaggtgatgtgacactcctgcttgg

SEQ ID NO: 122918 - DNA, 556 bp, Homo sapiens
  Payload ID: 4127
  Gene Symbol:
  Gene Name: CTD-2574D22.6
  ENST ID: ENST00000562285
  CDS Start-End: 1-254
atgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcc

SEQ ID NO: 122919 - DNA, 556 bp, Homo sapiens
  Payload ID: 4128
  Gene Symbol:
  Gene Name: CTD-2583A14.10
  ENST ID: ENST00000593873
  CDS Start-End: 343-556
ctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcac

SEQ ID NO: 122920 - DNA, 606 bp, Homo sapiens
  Payload ID: 4128
  Gene Symbol:
  Gene Name: CTD-2583A14.10
  ENST ID: ENST00000598031
  CDS Start-End: 108-606
aatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcac

SEQ ID NO: 122921 - DNA, 769 bp, Homo sapiens
  Payload ID: 4128
  Gene Symbol:
  Gene Name: CTD-2583A14.10
  ENST ID: ENST00000596498
  CDS Start-End: 370-769
ctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggagcaacttggcgaggttcagactcttggagccagaagctacatgacccctaaacgggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttggga

SEQ ID NO: 122922 - DNA, 540 bp, Homo sapiens
  Payload ID: 4128
  Gene Symbol:
  Gene Name: CTD-2583A14.10
  ENST ID: ENST00000597134
  CDS Start-End: 507-540
cggggtcctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggagcaacttggcgaggttcagactcttggagccagaagctacatgacccctaaacgggcacagtgacttttgaagacgtggctgtgaaatttacccaggaggaatggaatctccttagtgaggctcagagatgcctgtaccgtgatgtgactctggagaacctggcacttatgtcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgg

SEQ ID NO: 122923 - DNA, 580 bp, Homo sapiens
  Payload ID: 4128
  Gene Symbol:
  Gene Name: CTD-2583A14.10
  ENST ID: ENST00000603271
  CDS Start-End: 183-580
gtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcata

SEQ ID NO: 122924 - DNA, 576 bp, Homo sapiens
  Payload ID: 4128
  Gene Symbol:
  Gene Name: CTD-2583A14.10
  ENST ID: ENST00000604231
  CDS Start-End: 218-400
tttatttgtcggagaggctcctgagcgctaggtcggcactgcggtgactgaacccagaaggcggagaacagttgtcctctgctgcacagaggcgactctggagctctgtgacggcgccaagcgtgacccacccctgggccaggatagggaccgtcatgcccatatctcctggctggtcaccctctcctcccaaccctgctttaaaccacgtggttcgatggcggtggtggccacgctgaggctctctgctcagggcacagtgacttttgaagacgtggctgtgaaatttacccaggaggaatggaatctccttagtgaggctcagagatgcctgtaccgtgatgtgactctggagaacctggcacttatgtcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagt

SEQ ID NO: 122925 - DNA, 1020 bp, Homo sapiens
  Payload ID: 4129
  Gene Symbol:
  Gene Name: CTD-2583A14.9
  ENST ID: ENST00000602124
  CDS Start-End: 408-536
gtagcggctgtgtatcggtgacgcgggtgtttccccagtttgtggcccctgagtgctggggggggaccgcggtgactgaacctagaaggtggagaggaatcgtcctcggtgcccagaggcggctctgcagccccgtgacggcgaccactgctcccgggccgtgcttccccaagtagtccgatggcagcggctgcgccgaggcgcccgactcagagtgaaaccatgaactgaattccttccctaagttaattcagcctatacccaggaatgaacaaggacagctgaaaggttggaagcaagacggagtcagtaagggcactgtgacctttgaagatgtggctgtgaacttttcccaggaggagtggtgtcttcttagtgaggctcagaggtgcttgtaccgtgatgtgatgctagagaacctggctctcatatcctcgctggattgtcctctgcatctgtgccagtttcctgatttgtccccatgttggagggtctgcctggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggtaagttgctcacactcaccctgtgacctgagctagtctctgttttcccctatctttccccattggtaagactttctcatgtcaggagcatggacacagcttcctgcttcagttctgtgggtaggttcttggttggtaggtctgaggtgta

SEQ ID NO: 122926 - DNA, 975 bp, Homo sapiens
  Payload ID: 4130
  Gene Symbol:
  Gene Name: CTD-2587H24.4
  ENST ID: ENST00000587871
  CDS Start-End: 1-517
cgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcaggtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggtgagtgatgccccaagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcac

SEQ ID NO: 122927 - DNA, 551 bp, Homo sapiens
  Payload ID: 4131
  Gene Symbol:
  Gene Name: CTD-2616J11.11
  ENST ID: ENST00000600067
  CDS Start-End: 100-231
agcttccggttgcggccgaacccgtagtgactggggcggcgcccgcgggggctgatgcgcccgctctccccagccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcgatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgta

SEQ ID NO: 122928 - DNA, 3547 bp, Homo sapiens
  Payload ID: 4132
  Gene Symbol:
  Gene Name: CTD-3074O7.11
  ENST ID: ENST00000419755
  CDS Start-End: 79-1971
gctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 122929 - DNA, 10568 bp, Homo sapiens
  Payload ID: 4133
  Gene Symbol:
  Gene Name: CTD-3088G3.8
  ENST ID: ENST00000598234
  CDS Start-End: 154-9849
gctggcattatcatttctcatcttcttcccagagtaaggtcagtggcccatagcgtggggctatcttatgcctctttctggcctcaccctggttccatctgatttgcgatttcagaaattccagattcgcaggtggggcaggtggcctcctgcatgactgcgtgcacagggtcagctgggccccacctccctgtgggcaccagatacacctatcatttttccaccaacaccagcaccagcctgcaggacgtcctggtggaggggagtggtcttggcctccaaggcttggctgtccttgatgtgcttggcctgtgccagatggctttatggctccaagacttccaggtgacatccatcctgggggccaaggtggagcttctgaaggagtcggagagcctgagtgccaccctgggccgtaacccactccgcttcatcctgcactctgggcgtgtggcccacctgtgtccccatcccactgagccacgctgggtgctgaacgtgaagcgtgctgtgctgagcctcctgcagggccacccaggggcccacagccccaagacctttgatgaggtggacatcctgggccgatgtcctaccacataccagcaccatggggactggctacacaagacaaaggacctggcacggtgctccctgcgcaggggacgctcatcactccattctcaggccctgcctggagtggctcccggcctgacctcccgcctgacctgcgtccagagcttccgggccggagtgctgagggaggcctcctgcacagagctggactccgcggggccacttcctgcaaaggcaagcgctgtgcagatgaggaccctctcctcactcagtctgctgcacgagatgccccaagatccagcgggcacagatccagatgatagagacgatgaagacatgaccccaagcagcctgctgtatgagtgggaggagacaccatcccaggccatggtggccaccgcagccacattagtaaggaggctgtgcctggctcagaccactagcttggaggccatggacttgttcctgacactggtgtcccagctccagggcctttctgggggtgagctgatggaactctggcaatattcttccttcaaatgccgagacaatgggcagccactgttggatgccctgccttcctgtgggacggagcactgtgtgggcctcatgaaggaactcatcgcatcagccgcggtggaggcagacgaggtggaggcgtggctctcatcactggccttcctcccacagcccacagatgctatggtccacatgctgctgccactgctccagaccccgagggccagccctggcgccttcctgggcatctcagccctggtgcacaacctctgtgcttctctggacgggccctgcggccagctgcctggagtcggctccctagtgaggatcctgggagacgccttgggtgagaactgtaccatccaggagccctcggatgatgacaagctccagcttgtgctgaaggcagtcggcaacgcgggcttggcagccatggctctcacccctacgttgagtgcctgtgcatctctgagaagcagcacacccgagatccggctgggggccatccaggccttccgaagggtcccctgctctgcagacagatcggtgctctcccgtctataccaatccctggaggaggatgctgagatccgtatcaatgcctacctggccctgatgagatgccccagtgaggaggtgtttgcccaggtgcggcgcacccaggcaggcgagctctccacccaggtgggttcttttgtgtggagtcacatcctgcagctgctggagacgcacgaccccctgaaacgggccctccgggacaccctccccgaggacatcctcagccaggagttccacccagaaatgtggaaacactcgtcctattctgatgtcaccttccgatcagtgtctggcagcctgggagccaacctggaggggacccttctcttctctcctgcctcctttcttccccgttctgccacagtcaacctgaccatccacaccatgggccgtgccttcaaccttctggagcttgggctccggctggaaaatgctgaggaaattgctcacaggctgtttggcaggaagtcattctggggtcaggaagacgggagagagcctgagccagaggaacccccagggccagaaccagggcctgcaccacagccagccagccccgagtgtccaggagacagagacagaaggatgagatacctacagcagaaggtgacccggaggcgtggggcccggcaggctctgcgatgcgagctgagcgtgaagttgctggggcaggagctgagctttgtgaactgcggggccacggggagtcacgtgaaccactggccccttaacttggccgagctcgccatcaagctcatgaaggggcaggaggtgcagatgaaccggaggctgagcctggccgcacaggaactggtctttcccaccgtgtctggccttcctgcccggctgaccctaaatgcctcggctgccatcagcatccgggtccgaggaaccactgacttccagcagcgctcggatttctctgtgaatggttatgtcaagcccagtgccctgctccagatctcagctcagatgggcacagcgggcatcctggggcaggccgggctgaggtgggtgaccagcgtccgcagcgccgccagcctggatggcgggatccaggtgcagaagggccgggtccttaaggtgcatctgaacacgcctgaggaggccgtggagctgctcagcttcagctctcagctgtacctcatcaccagggatggcgtgaggagcctcagacatgtccctggcccttctgaggtccagtcctgtactggtgaggaagtgtcctacacctggggctggcgactgtgcactggagtgacctggccggtgcctggccagccctacctgctctcattgcctgtgttcgcggccgtgacgctgcagaaacgggacccggggctccgacagtacctgctggaagctgcctataccctgcagccccagaagggcagctggttcccccaagaagccacagcccacgtcttcatgggcacgcccgggtcagaagtgctgagggacgtcggggtggacatgagctacagcttgccccagaacaagttccggctcaagcttctccatcccaagaagaaaatcgagctggacggaaagatggaggctcttgggagtgcccacacgggtcacttggagctggtgctggatgacagggacgtctactacatcaagggctggagtgacctgcagccagccatgggtggcgaggctgagcggttccaggcgcagctggaggtgaaactggtgacggggggcagccccgtcgtcttcaccgggaacctcacacggcaggtgggcagcaagctggccttctccgcatcgctgagccatctgctgagtgaccaggccaacgtgacagcactgctggagaggaaggaggagaatggacggagggtggccgccctgggtgccgagctgtttgtgccagggctggtggggcttcgtgcccttggcctgctgcagcaacggggccagctctggaccaactccctgaggatccagtacagcctcctgggtcaggcaaagcaggcggcacacgagtgcagcaccagccagaagctgcgggcagacagtggctcagacggtgcctacaggctggagctgcgccacgagctccactgcacacagatcctagccttcagccacaaggtccagctctggcatgaggaggactcgggccacctgcactcacagctggaggtgagctacgggaagcactgggacaagaacagcaacaagaggcatctccgtgtcagccagaccttcaagaatgactcggggcccgccctgagcaatcacttcatggagtttgtgctgcaggtgcctgagaggcaggtggattgccgcgtgcagctttaccacttgagcctccgcctgccctatgtggagagcagcagtcacctgaaggtgcagtacaatgggcggccgctgtttgtggcaggcgggcagtggaaggacacatctcgggccaccctgtggaagtgggaaggagccttgaacctggatagtccatggctgatggtctctgcagctcacaggctatactggccacaccgagctgtgttccaggctgtcctggagctaacgctgggcaaggcctggaccctaaaggacctggtggtcagcgtgggctgcaggagtcagggccccaacagggaaggcaagatccaggtttacaccgcagctaccacctacctccgggtttccacagtgacagtcttggcacagagcctcttccacagctggagcgaactcgagtcagcctggaacgcagcagtgcagggcgagatccatgctgagaacagccgggaccgtaagatcctgaactgctggttgaaaggcccccagcaggagctgaacctaacagcggcctacaggcacctggagtggccccggaagacccaggtgtcgctcacggctgtgcggattggtgcccagggccagcctcggggcctgcagttggaaggagagctggaggagctgaggcaagacaggacattgtaccggaaacggggggccttgctccttaggcacccgttgcacctgcccatcccgcagagcctcctcctgcaggagaccttcacagctgataggcgacaccagcgctattccctggagactagggttgtcctgaatggccgagaggaaaccctgcagaccatggtcctgggctgccaggccggacacccctacgtctgtgcaggtctgatgcatccatacgatggcaaagtcatccccaggaacacagaggggtgcctggttacttggaatcagcacacggctaagaacagagaggtcgaggccactttgaaagtccaccggaaagttgtcctgcacttgaagggtttgcatcatgacagatctcagcatggggaaatccggcacagcctggccctggacttggcccattcctaccagctgagcttcccccaggccctgagcttggatgggggcatcatctttagacagagtccccaaggaacattcaactttggcatggatgcacgagctgccgtcaatcacaacgtcacatcccaggcctcggtccagctgaacggatctgactccgactttgcatttttcttccaactcaggcatcctcacggaccaacatttcctccaaacttccaggtgcaggcagctgccgggcgctacagagtgcgcagcctcaacgggtctctatctgtgcaaatgtctggccgggagctggttctgctggaggtcgacgccagccaggacactcggaggagcagccggggctggggtgtgagtgtccttctccaccaggctgtcctcagtgcccccagggctgttcggctgcagctgtctgcaaagatcaccccagcaaggatttggctgttttccaaggcactgctggaccagaacacagcacagttgctcctcaaggcatctgaggaatggaggggaggccggatcctgactttccagagccaaacccggcacacggtggctggctgggcagcgatgccccgcctcctgacactcacaggaaggctgaagcagaaggagacacttcaagagggcaccctcagtgtcactgctgactcagctgtgctgggcttcctcctgcgggaccagcatgagaaggcagggaacggcaccagcgtgcgcagcgtgacctgtgtccttgcccagaacagcagccaggccttgcctggagagctccagctgaagggccggctgcaggcccagacgaggaacctgagggcccaggccagcatccgggcccatgcagccagcctggctctgggtggcgcctgctcctggggcccccggcacggacagcttgcgggtggcccgacacacaatatcagcacgctgagtgatgcaggactcccctccgaggcagggatgctcctgtctctcacccacgtggcttccaactgctcagcacgcctggcgctgtggaacgcgggggctcagctagacggtgccattggcctggaggacgtgacccccgagtcctcgggcctccagctccatgccagcctccgtcacacccacaccatgcccagcctcaagcactggggcctccccttctccttagatggccacgggcacttccaggtcaactgcagtggagacgcctcgcccacccagctgttaggatggtgccgaggggacatcgctgggcagcctctcgaggtctctgtggacattcacaatggcagctccggcttcgagcattctggacgcatcctgatggggcccacattcctcaactactctgtgagctgctattaccatgatgggcacctggagctctccggccggagctggcacaacagtgaggctttgttgtgggcagggttcccaggcgaggcctgccttagtgctgagctgcagatacacgagacccagacccaggccagggtggccctccatggtggggacagtggagtcagcatggacctggcagccctggtggctcggccacgacgtggcccactgcagctggtggccagtgccagccacacagtgcctgctctccagaggctgggcctgcccttcaccaaccagctcgtgttccaaggactctgggaggcagaagagatgagctcctcactgcagctgacctgcgattctcaggccaccttggtccttgacgtccgtggccagaaccaggcagtcagcaaagagctgctgttctcaggccggcatcgcctccccttcctcctgggtctctgccccagctcagcctcagcctcagctaagctacactactccaagggtgaggttcagagcatgttcgccttgggcgtggaggagcgtcattttcacatcagcacccggcaggtagctgctaaggccggtctcaacaatttcatcaaactggaacagacctttctgcagctcagcgctcttcccagggagctgttcctgcagaccgcatacgagcgagctcatgggacccgtgtcctgcgccaggtggtgctgtgggatggccaggaggtggccctcaccgggagcctttctgggcctttccccaagcccaccaggaacctcagcctgcaggtggagctcacccacccgctgcccctccccctgccgcgacactgcagcctccgcctgtcctcagagcatttgggaggcagccaccgggatggcctggttgtcggctgggatggcagggaccaggtgctggtctcctcctccctgtggctggggaagagtgagctggccgcccgcctggccctggctcacccattcaacctcccttggcggcaagccgaggccagtggccttgctgagagcaggggtggcaggcagagccggcaggtgcagctcacctggaacagaggacaacctgcgacgctgcagctcacctgggctgacgggtccttagcacacagcaccgcctgggacggctgcctggccgcctccccggggcagctccaggaaacctggggcctgaacagcctccaggcctgcggggccttcacgcagaccccagctgtgttcgttgaacagctcaacgtgtcctggggccagcaccgcatgcggcagaacttgacctacgagaggcattggccatctcagccagacaagatcatcatggaggccacgctggagcacgtcctcggggcctcttgtacccgtcagagcttctggggagaagtacagactgactatgcacgctggctgcggcactccctccacctggggctctgtgacctgcccagggccctcttggtcgtcggggagcacaccctgggccagggtggactcctgctgcgttcccgctgccacctgggccttgcaccagacccagaccacggcctgcatctcagcctgaccctccaaaaccacagcaggcctcgttcagctgacttctccggggcactggagcttcgtggctccaaggctcagcgggttggcctactgggccgtgtctccacctcgacttctcaaagcctggtccggttggagggaagcgtggacaacagagaggagaaagtgaggctgtctgtgttccgggccccaagctgtctgcaggcctctgtggcccatgaggaggggggcagagaggagagtgtggtgctgcgggcatgtgcccatgggcggacagccgaggcggaggtcctgttccgggatggcaggcagccctcccagccgctgggacgcctgaccctgcaggctgccaaccagagtctcctgctggccgcgcgcggctgccaggggggcctgctgggccatgtggagtccaggattgcagcagttggctcccaggtgcaagcccggctggaagagaaggttcaaggcttgggtgcctctgtgagaaggttccagcaattggtgcagccggcaggcaccctggacggcgtggcaggcctccttctgcagctgtcccaggcggggcgggaggccatgcaggcgagtggttgggcagtagccactttgtgggcccggagccaggcactgacccagcacctgcctctttacctggagtggctgcaggtggggctggagcagctgcgggaggagctggaatggcccctggccacactgaaggatgcctacctggaggtgacactgcggcccctggaggaggtgtggcgggagcgagcagaggaggccatgcggcggctgcaggcctgggtgcccgggatgccaggcaaagggggtccaaggcccatcagggcggccctgggggccatgaaaggagccctggagctggccgcccaacagatgctgtcttgggctgaggccacgttctcacgggcactgaagaggctctgcaaaccactgctggacctgtacagcctgtcggccaggaaccgctcagtggtggtgatgctgccactgttgcctgcgggggacgagcccctggacgtggcccgggtgaccagctacctcatggaggagaagctgctgcggccgctccgagagctgtctggggccaacgtgctggctgagtactactggctcagacgccgcctgctggcgggcccctgggaataccatgccctggtggctggggcccagcacgtggtgaccttcgacggccgggtatgggacctcagcacccagtgcggcagcatcctcctggcccaggactttgctcacaacacattctcgctgacgctgagtcggacaggctcggggctcacagccctgttcgtggaacttaaccacaagaccctcatcctctaccccagtctgcaggcctacaggctgtacaactcctccctgccgggggacagttgtccggacctcaagctgcatcctgccacgacaaggaaggacgtctccaggattgagctggccagcgaggacggggtgtctgtctcctgtgacgtgcccaccggcctctgcagcctgactctgggcctctggcagcacggcatatccgctggccttctgggcaccaatgacaatgaagcaggcaatgagctgatgttgccggatggctctatggcccgcagcctggaggagctcagcctggcctggcaggtgggtggtgactgcagggccactgagaagcctcagcaggagcaggcctgcccgggacagctccccgcctgctgggccttcttcgagggcccccactccagcttgagggactgcttccgggtggtagaccctacaccattcctcagcctgtgtgtgcaggtcccctgtggcacccaggagctccagcctgcctgcaacctggcggccgcctacatccacctgtgtgcccgtggattcgtacccctggcccctcctccacagtgtgtttgagattttgtctatgccagcactaggctgccagacttcaaactccttcaccttctactgcaattccagctccctgacaatgacaagattcatggctgggacagaataaccagcatggaatgccgggaaactcagaaccgcacgtgctgcaaacgcacggaagcagggctcattgccactgggctcaaaatacttccgggggacatgaaactctcccactggtctgagtaattctcccccttcctccacacttccactgcaaaccaggagacagtgcggccagcaagtaccagctctgcagagaaaactccacctggcccctgttcatgcccaagagatttattcacttattcaacagccatttgggaagccactgcttcagaacgctgactgcgtggtgggggacacgaagccaggtcctcagctgcttggtactggctttccctgcctgatccaggggtcttttcaggcaggagtttccttgaagggaagtgatggccccaagcctcttaatcagaagcccaggtaggcagcttctctctttggggtagacacactgggactgaatgcttcaggggaccctggggagggcctctgttttggtaggggcacctgtgaactcaggcctccaggctacatcattggaagtgttttactttcttttgggaatgtaactttttcctttgagttttcaactgaaaaataaagctggcagaatccaa

SEQ ID NO: 122930 - DNA, 3552 bp, Homo sapiens
  Payload ID: 4133
  Gene Symbol:
  Gene Name: CTD-3088G3.8
  ENST ID: ENST00000595170
  CDS Start-End: 1-240
gaggaggtgtttgcccaggtgcggcgcacccaggcaggcgagctctccacccaggtgggttcttttgtgtggagtcacatcctgcagctgctggagacgcacgaccccctgaaacgggccctccgggacaccctccccgaggacatcctcagccaggagttccacccagaaatgtggaaacactcgtcctattctgatgtcaccttccgatcagcttgggctccggctggaaaatgctgaggaaattgctcacaggctgtttggcaggaagtcattctggggtcaggaagacgggagagagcctgagccagaggaacccccagggccagaaccagggcctgcaccacagccagccagccccgagtgtccaggagacagagacagaaggatgagatacctacagcagaaggtgacccggaggcgtggggcccggcaggctctgcgatgcgagctgagcgtgaagttgctggggcaggagctgagctttgtgaactgcggggccacggggagtcacgtgaaccactggccccttaacttggccgagctcgccatcaagctcatgaaggggcaggaggtgcagatgaaccggaggctgagcctggccgcacaggaactggtctttcccaccgtgtctggccttcctgcccggctgaccctaaatgcctcggctgccatcagcatccgggtccgaggaaccactgacttccagcagcgctcggatttctctgtgaatggttatgtcaagcccagtgccctgctccagatctcagctcagatgggcacagcgggcatcctggggcaggccgggctgaggtgggtgaccagcgtccgcagcgccgccagcctggatggcgggatccaggtgcagaagggccgggtccttaaggtgcatctgaacacgcctgaggaggccgtggagctgctcagcttcagctctcagctgtacctcatcaccagggatggcgtgaggagcctcagacatgtccctggcccttctgaggtccagtcctgtactggtgaggaagtgtcctacacctggggctggcgactgtgcactggagtgacctggccggtgcctggccagccctacctgctctcattgcctgtgttcgcggccgtgacgctgcagaaacgggacccggggctccgacagtacctgctggaagctgcctataccctgcagccccagaagggcagctggttcccccaagaagccacagcccacgtcttcatgggcacgcccgggtcagaagtgctgagggacgtcggggtggacatgagctacagcttgccccagaacaagttccggctcaagcttctccatcccaagaagaaaatcgagctggacggaaagatggaggctcttgggagtgcccacacgggtcacttggagctggtgctggatgacagggacgtctactacatcaagcttggcagctgggcgccgtggctcacgcctgtaatcccaacacttggggaggccaaggaggatggatcacttgaggccaggagtttgagaccagcctggccaacatgggctggagtgacctgcagccagccatgggtggcgaggctgagcggttccaggcgcagctggaggtgaaactggtgacggggggcagccccgtcgtcttcaccgggaacctcacacggcaggtgggcagcaagctggccttctccgcatcgctgagccatctgctgagtgaccaggccaacgtgacagcactgctggagaggaaggaggagaatggacggagggtggccgccctgggtgccgagctgtttgtgccagggctggtggggcttcgtgcccttggcctgctgcagcaacggggccagctctggaccaactccctgaggatccagtacagcctcctgggtcaggcaaagcaggcggcacacgagtgcagcaccagccagaagctgcgggcagacagtggctcagacggtgcctacaggctggagctgcgccacgagctccactgcacacagatcctagccttcagccacaaggtccagctctggcatgaggaggactcgggccacctgcactcacagctggaggtgagctacgggaagcactgggacaagaacagcaacaagaggcatctccgtgtcagccagaccttcaagaatgactcggggcccgccctgagcaatcacttcatggagtttgtgctgcaggtgcctgagaggcaggtggattgccgcgtgcagctttaccacttgagcctccgcctgccctatgtggagagcagcagtcacctgaaggtgcagtacaatgggcggccgctgtttgtggcaggcgggcagtggaaggacacatctcgggccaccctgtggaagtgggaaggagccttgaacctggatagtccatggctgatggtctctgcagctcacaggctatactggccacaccgagctgtgttccaggctgtcctggagctaacgctgggcaaggcctggaccctaaaggacctggtggtcagcgtgggctgcaggagtcagggccccaacagggaaggcaagatccaggtttacaccgcagctaccacctacctccgggtttccacagtgacagtcttggcacagagcctcttccacagctggagcgaactcgagtcagcctggaacgcagcagtgcagggcgagatccatgctgagaacagccgggaccgtaagatcctgaactgctggttgaaaggcccccagcaggagctgaacctaacagcggcctacaggcacctggagtggccccggaagacccaggtgtcgctcacggctgtgcggattggtgcccagggccagcctcggggcctgcagttggaaggagagctggaggagctgaggcaagacaggacattgtaccggaaacggggggccttgctccttaggcacccgttgcacctgcccatcccgcagagcctcctcctgcaggagaccttcacagctgataggcgacaccagcgctattccctggagactagggttgtcctgaatggccgagaggaaaccctgcagaccatggtcctgggctgccaggccggacacccctacgtctgtgcaggtctgatgcatccatacgatggcaaagtcatccccaggaacacagaggggtgcctggttacttggaatcagcacacgagtctcactctgttgtctaggctggagtctggagtgcaatgacttgatctcagctcaccgcaacctccacgtcccaggctgggcgagatggctcacgcctgtaatactagcactttgggaggccgaggcaggcggatcatttgaggtcaggagttcgagaccagcctgaccaacatggtgaaacccccatctctactaaatacaaaaaaaattagccaggcatggtggcgggctcctgtaatcccagttactcaggaggctgaggcaggagaatcgcttgaacctgggaggtggaggttgcagtgagccgagatcacgccactgcactccagcctgggtgacagagcgaggctgtctctaaaataaaataaaatataaaatagaataaaataagctgtttaatgacat

SEQ ID NO: 122931 - DNA, 550 bp, Homo sapiens
  Payload ID: 4133
  Gene Symbol:
  Gene Name: CTD-3088G3.8
  ENST ID: ENST00000595168
  CDS Start-End: 1-141
gcggccgcctacatccacctgtgtgcccgtggattcgtacccctggcccctcctccacagtgtgacacgattccaacccgttggatacaccttcccccagtcattcaatcgaacacgaatctaggtgttgctgtgcagtgattctggagaggtaaagtcccaagtcacctgaccttaaggtagggggcctgagccaatcacatgagccctctctaaacctgggcccaggaaatcagaggctggagagcaggaggcagattcaaggctcgttcctgaagatggaggggacctctaggagcctccagtttacagccggcaaggaaatgggacctcagccctacaattgcaaggaactgaattctgccaacagcctgatgagcctggatgcccattcgggattcttcccagagcctcctgaagagagctcagctggctgacaccttgattttggcctgaagaggtcctgagcagagaacctaacaacaccctaccagaccccgacccacagaaactgtgagatattaatacatttgtttttttaagctgctaa

SEQ ID NO: 122932 - DNA, 2085 bp, Homo sapiens
  Payload ID: 4133
  Gene Symbol:
  Gene Name: CTD-3088G3.8
  ENST ID: ENST00000599216
  CDS Start-End: 1-1366
ggctggaagagaaggttcaaggcttgggtgcctctgtgagaaggttccagcaattggtgcagccggcaggcaccctggacggcgtggcaggcctccttctgcagctgtcccaggcggggcgggaggccatgcagggcccctggccacactgaaggatgcctacctggaggtgacactgcggcccctggaggaggtgtggcgggagcgagcagaggaggccatgcggcggctgcaggcctgggtgcccgggatgccaggcaaagggggtccaaggcccatcagggcggccctgggggccatgaaaggagccctggagctggccgcccaacagatgctgtcttgggctgaggccacgttctcacgggcactgaagaggctctgcaaaccactgctggacctgtacagcctgtcggccaggaaccgctcagtggtggtgatgctgccactgttgcctgcgggggacgagcccctggacgtggcccgggtgaccagctacctcatggaggagaagctgctgcggccgctccgagagctgtctggggccaacgtgctggctgagtactactggctcagacgccgcctgctggcgggcccctgggaataccatgccctggtggctggggcccagcacgtggtgaccttcgacggccgggtatgggacctcagcacccagtgcggcagcatcctcctggcccaggactttgctcacaacacattctcgctgacgctgagtcggacaggctcggggctcacagccctgttcgtggaacttaaccacaagaccctcatcctctaccccagtctgcaggcctacaggctgtacaactcctccctgccgggggacagttgtccggacctcaagctgcatcctgccacgacaaggaaggacgtctccaggattgagctggccagcgaggacggggtgtctgtctcctgtgacgtgcccaccggcctctgcagcctgactctgggcctctggcagcacggcatatccgctggccttctgggcaccaatgacaatgaagcaggcaatgagctgatgttgccggatggctctatggcccgcagcctggaggagctcagcctggcctggcaggtgggtggtgactgcagggccactgagaagcctcagcaggagcaggcctgcccgggacagctccccgcctgctgggccttcttcgagggcccccactccagcttgagggactgcttccgggtggtagaccctacaccattcctcagcctgtgtgtgcaggtcccctgtggcacccaggagctccagcctgcctgcaacctggcggccgcctacatccacctgtgtgcccgtggattcgtacccctggcccctcctccacagtgtgtttgagattttgtctatgccagcactaggctgccagacttcaaactccttcaccttctactgcaattccagctccctgacaatgacaagattcatggctgggacagaataaccagcatggaatgccgggaaactcagaaccgcacgtgctgcaaacgcacggaagcagggctcattgccactgggctcaaaatacttccgggggacatgaaactctcccactggtctgagtaattctcccccttcctccacacttccactgcaaaccaggagacagtgcggccagcaagtaccagctctgcagagaaaactccacctggcccctgttcatgcccaagagatttattcacttattcaacagccatttgggaagccactgcttcagaacgctgactgcgtggtgggggacacgaagccaggtcctcagctgcttggtactggctttccctgcctgatccaggggtcttttcaggcaggagtttccttgaagggaagtgatggccccaagcctcttaatcagaagcccaggtaggcagcttctctctttggggtagacacactgggactgaatgcttcaggggaccctggggagggcctctgttttggtaggggcacctgtgaactcaggcctccaggctacatcattggaagtgttttactttcttttgggaatgtaactttttcctttgagttttcaactgaaaaataaagctggcagaatccaa

SEQ ID NO: 122933 - DNA, 2593 bp, Homo sapiens
  Payload ID: 4134
  Gene Symbol:
  Gene Name: CTD-3105H18.14
  ENST ID: ENST00000435033
  CDS Start-End: 205-345
actgtcaatcaggcgcgcttcccagaggagtgtgtggttgaaaaagcccgcggcgtcttctccacccacctgcgctgggcgctcggtgctcggctctgtagctaagagacgacctggaagttccgtggcagcctgtgtcccgcgggaacccgcattggcagcgggagccgtccggaggacctgggacaccgcggaagtcgggaaatggactcagttgcctttgaggatgtggctgtgaacttcacccaggaagagtgggctttgctgggtccttgccagaagaatctctacgaagatgtgatgcaggaaaccatcaggaacctggactgtgtaggaatgaaatgagaagaccagatcagggaagatcaatacgaaagtcacaggataaatgtaagatgcgatatggtagagcgcttcggtgaaagtaaagacagtagtcattgtggagaaacatctagccagattggagatactgttgtgaacaagcacatgcctcctggagtaggtccacgtgaaaacaatgagtggagaagtcgtcacgggtctttcatcccttcattgccacatcagagttgatgctgggcacaaaccacatgagtatcaggaatatggagagaagcgtaatacacgtaaacaattttggaaaaccttcagttattgccactcgtttcaaacccacaaaatttctcacacaggacacaaaccatatgattgtaaggaatgtaggaagtccttcaattctttgggaaaccttcaaagacacatggcagtgcagcatggagatggaccttataaatgtaagttgtgtgggaaagcatttttctggcccagtttatttcgtatgcatgaaagaactcactctggagagaaactatatgaatgtaagcagtgttctaaagcctttcatttttacagttcttatctaagacatgaaagaacacgtactggggagaaactgtatgaatgtaagcagtgttctaaagccttccctgattacagttcttgtctaagacatgaaaaaactcacactggagagaaactctgtacatgtaaacaatgtgggaaagccttcagtgcttccacttcccttcaaagacgtgaaaccactcacagtgcagagaaaccccatgaatgtaagcaatgtgggaaagcatttgatcatctgggaagcttccaaagacacatgataaggcacactagagatggacctcataaatgtaagatatgtgggaaaggctttgattgttccagtacactgcaaagtcatgaaagaactcacactggagagaagaaactctatgaatgcaagcagtgtgggaaagcgttatctcatagctcaagctttcgaagacacatgacaatgcacactggagatggacctcacaaaatgcaagatatgtgggaaagcctttgtttatttcattggatttcaaagacatgaaaggactcacactagggagaaaatctataaatgtaaatgtgggaaagcctttagtgatctttattcccttcaaaatcatgagacaactcatatgggagagaagccatatgaatgtaaataatgtgggaaagcatttggttgtttccagtacctttctcttcataaaaaaatcatacagcagaaaaaccttatgagtgtcaaacatgtagaaaagccttcagtcattttggtcacttaaagcaacatgaaaggattcacactggagagaagccgtatgaatgtaaggaatgcaggaaagcattctcttggctcacttgccttctacaacatgaaagaattcacactcgagagaaaccttatgaaggtaaacaatgtggtaaagccttcactcattcccgtttccttcaaggacatgaaagaactcataccgcaaagaagctatgtgaatgtaaggaatgtggaaaagcattgagttctctcagctccttgcacagacacaaaaggactcattggaaagatactctataaatgtgtggaatgtgggaaagcattcattaattttattttacctgagaaaattaaacaaatcacattggaaataaactctatggcttgggcacggtggctcatgcctgtaatccctaacactttgggaggccgaggtgggcggatcacgaggtcaggagatcaagaccatcctggccaacatggtgaaaccctgtctctactaaaatacaaaaacttagccaggcatggtggtgcgcacctgtagtcccagctactctggaggctgaggcaggggaatggctcgaacacaggagacggagattgcagtgagctgagatggcgccactgcactccagcctggcaacagagtgagactccatctcaaaaaaaataaaaaaaaagaaaaagaaataaactctatgaatgtaaaccatgtggtgaaggcttaagtgatttcagtttatttcaaatacagttttcccctgacatatgcaggggattaattccagcagtccctgatcatacctaaatccacacatgccaagtttcttttataaaattacatatttgcatgttatctacccacatctccctgtacactctaagtcatctctggattaaatacctcatgcattgtaaaaacta

SEQ ID NO: 122934 - DNA, 617 bp, Homo sapiens
  Payload ID: 4135
  Gene Symbol:
  Gene Name: CTD-3105H18.16
  ENST ID: ENST00000595562
  CDS Start-End: 169-617
gtgtgtggttgaaaaagcccgcggcgtctgctccacccacctgcgctcggctctgggttctgtagctgagagacgacctggaagttctgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagcctt

SEQ ID NO: 122935 - DNA, 588 bp, Homo sapiens
  Payload ID: 4136
  Gene Symbol:
  Gene Name: CTD-3105H18.18
  ENST ID: ENST00000598753
  CDS Start-End: 160-402
gcaaacggcgagggcgtggctaccagccgctgcgctccgctctggggtctcctcaccccagaaggccctcaggtggaggaagggcctcaggtggaggtaggacctgtgctggccgcgggagaggtaaacagaacaccaggacatcccagagtctgggaaatggactcagtggtctttgaggatgtggctgtgaacttcacccaggaggagtgggctttgctgggtccctctcagaagaaactctacagagatgtgatgcaagaaacctttgttaacttggcctctataggggaaaactgggaggagaagaacattgaagatcacaaaaatcaggggagaaagctaagagatggggttttgccatgttgcccagactggtctcaaactcctgagctcaagtgatccacctgcttcagcctcccaaaatactgggattataggcgtgagccaccatgcccagccaaaaactttaaacttagaagaacattgcaaggcctcagtggctttagaggatgtggctgtgaacttcacccgagaagagtgggctttgctgggtccttgtcagaagaatctctacaaagatgtgat

SEQ ID NO: 122936 - DNA, 675 bp, Homo sapiens
  Payload ID: 4137
  Gene Symbol:
  Gene Name: CTD-3148I10.9
  ENST ID: ENST00000599536
  CDS Start-End: 1-217
acaggtgttccaggctggtgatgtgccttcggaacgcccattctatcccccaaccttggtctccaacctgcccccagcctccccatgtgcccaggtggaggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagacccggcgacaggaggcatgaggggcccccggccgaaatgacagtgctggcgccagcctggagcccaacacggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 122937 - DNA, 777 bp, Homo sapiens
  Payload ID: 4138
  Gene Symbol:
  Gene Name: CTD-3214H19.16
  ENST ID: ENST00000597959
  CDS Start-End: 1-412
cgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccacggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 122938 - DNA, 762 bp, Homo sapiens
  Payload ID: 4139
  Gene Symbol:
  Gene Name: CTD-3214H19.4
  ENST ID: ENST00000595866
  CDS Start-End: 1-145
gggggtgaagctggagatatttcggatgataatctacctcactttccctgtggctatgttctgggtttccaatcaggccgagtggtttgaggacgatgtcatacagcgcaagagggagctgtggccacctgagaagaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgag

SEQ ID NO: 122939 - DNA, 570 bp, Homo sapiens
  Payload ID: 4139
  Gene Symbol:
  Gene Name: CTD-3214H19.4
  ENST ID: ENST00000599243
  CDS Start-End: 23-178
tttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagtttttgggggccgagtgagacccaggatgcctcaggccctcagggggcttgtgtcgggggctgggggctgctgttccgacggaagccgagagcggtcgggtcctgagggggtggcatttgagtgtgaggtggcaggtcttggggccctcgctgggatcttgatcagaacccaagcttcgtgtatgtgtgaagtcaacagataaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaag

SEQ ID NO: 122940 - DNA, 537 bp, Homo sapiens
  Payload ID: 4139
  Gene Symbol:
  Gene Name: CTD-3214H19.4
  ENST ID: ENST00000598664
  CDS Start-End: 39-224
tttgggcggaactggctttgttgaccgggagaaacgagatgggggtgaagctggagatatttcggagggagctgtggccacctgagaaggggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataag

SEQ ID NO: 122941 - DNA, 2567 bp, Homo sapiens
  Payload ID: 4140
  Gene Symbol:
  Gene Name: CTD-3222D19.2
  ENST ID: ENST00000409035
  CDS Start-End: 262-1545
actggagtttggttctcgaggcggcggcagcgagcggcggcggctccggcggctcctcctcctcctttggtggcggcggcggcccgggaccgagacccggccccggctcccctctccgccaccccgcgcgcccccaaccccccggcgccgcggggaacatgcggctccggctcccggaggccggcgagtgagtgacccccgtcccccgcctcagcccgcccgcccgctggcccggccgcaaccccccgcctcgcccaggcaatgacagcggctccggcgtctccgcagcagatcagggaccggctgctgcaggccatcgacccccagagcaacgaagtgcggtgtgaaacaacagtgatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgaggcggcgctgcgggggctggcgggggccaccggctctgccaacgggggcgcacacaactgccggccggaggtgggggcggctggcccacccaggagcatccatgacctgaagagccgcaatgacctccagaggctgcccgggcagcggctggacaggctgggcagccgcaagcgccggggtgaccagcgtgacctcggccacccagggccgccacccaaggtctccaaagctagccacgaccccctggtccccaactcatcccccctccccaccaacgggatcagtgggagtccagagagcttcgccagctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtcttgcgagattcacggatccaccatctccggctgctcaacatcctgggctgccacgccgtcttctttatgatccccacctgggttctggtggacctctcggctttcctggtcagcagcgacttgaccaagtacgatgcaaaccagcaagccaggaagcacctcctccccgtcaccacagcagacctgagcagcaaggagcgtcaccggagcccactggagaagccccacaacggcctcctcttcccccagcacggggactatcagctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtagcattggagaaaccgatggttgcagtccaccaatgactcccgatttgggcattttagactttcgtcgggcaagttttatggtcataaagagaaagataaaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtacgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaatctatgtttcaaa

SEQ ID NO: 122942 - DNA, 2297 bp, Homo sapiens
  Payload ID: 4141
  Gene Symbol: CTBP1
  Gene Name: C-terminal binding protein 1
  Uniprot ID: Q13363
  ENST ID: ENST00000290921
  CDS Start-End: 183-1505
tgtccccgcccgcgcggtcgtcggagcgcggctcagcggcgcggcggagactcggcacggcggcggccaggcgcaggcgggcgggcggagcagcggacggcgccgaggccgccccacgcgccgggctcgcggcggcgcagcgcgccggagtggtcggggcccgcggccgctcgcgcctctcgatgggcagctcgcacttgctcaacaagggcctgccgcttggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 122943 - DNA, 2467 bp, Homo sapiens
  Payload ID: 4141
  Gene Symbol: CTBP1
  Gene Name: C-terminal binding protein 1
  Uniprot ID: Q13363
  ENST ID: ENST00000382952
  CDS Start-End: 386-1675
gcgcggctcagcggcgcggcggagactcggcacggcggcggccaggcgcaggcgggcgggcggagcagcggacggcgccgaggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 122944 - DNA, 704 bp, Homo sapiens
  Payload ID: 4141
  Gene Symbol: CTBP1
  Gene Name: C-terminal binding protein 1
  ENST ID: ENST00000513420
  CDS Start-End: 269-704
gggaagggtcttgcgcatgcgcgggccgctgcgtgtgcgcgagcgccgcagtctgctctccccgcccgcggcccgtgcagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtcc

SEQ ID NO: 122945 - DNA, 1108 bp, Homo sapiens
  Payload ID: 4141
  Gene Symbol: CTBP1
  Gene Name: C-terminal binding protein 1
  ENST ID: ENST00000503594
  CDS Start-End: 1-553
ggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctatagcaggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaaccccccc

SEQ ID NO: 122946 - DNA, 920 bp, Homo sapiens
  Payload ID: 4141
  Gene Symbol: CTBP1
  Gene Name: C-terminal binding protein 1
  ENST ID: ENST00000504092
  CDS Start-End: 1-862
cctggagaagttcaaagccctccgcatcatcgtccggattggcagtggttttgacaacatcgacatcaagtcggccggggatttaggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggacc

SEQ ID NO: 122947 - DNA, 418 bp, Homo sapiens
  Payload ID: 4141
  Gene Symbol: CTBP1
  Gene Name: C-terminal binding protein 1
  ENST ID: ENST00000504784
  CDS Start-End: 1-74
ggatccgcggggagaccttgggcatcatcggacttggtgcacacaggaaaacattgtacacattcaccccatgaacccaccagcacgttgacagagcaggctcctgcacacagacagctccctcgggcccccttctcccgtggcggccccgcgacgaccctgcgaggacccgggtcccgcttcctagagcagagggccttccccagctgtgccgaggtgggatcacgggcacgcagccttctgtgtccgcctcccgtcagtcggggtgatgcctctgggtctcacctgtgttttcatacgacccagcagtttctgataacggttccatcacgtgaacacagcacgatttgcttctccagactcttggtgatgcattttgtaagtttttggctaatattacaaacaaaacttgtgtgaa

SEQ ID NO: 122948 - DNA, 4250 bp, Homo sapiens
  Payload ID: 4141
  Gene Symbol: CTBP1
  Gene Name: C-terminal binding protein 1
  ENST ID: ENST00000510568
  CDS Start-End: 593-1099
gcttccagaacaggaggcagagcctttccgcagtttccctgcccacagcacacaccctgtgccctccgtcccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccaggtaggtcccagacagcagtcccgggtgtggcagatgcagtgaggtccacttctgaggcgttccctggagtctgtgagttctggtcggaccttcgatggcattttaatgtgtctcttgtgtttgatttttagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtaccaccacgtggtcgcctggggctggcagaaccgcacgttggggggagttggagggacgggagcacggcaggcccgggccacagcaggtctgggtgccactggggcaggagcagcctctgtcccagtcgtcccgcgccgtcaggaggtggacacggggttttccctggacaccatcaggaggtggacatcgggtttgccctgagccccatcaggaggtggacacggggttttccctgtgccccatcaggaggtggacaccacgtttgtcctgagccccatcaggaggtggacattcggtttgccctgtgccccatcaggaggtggacacggggttttccctgagccccatcaggaggtggacactcgttttgccctgtgccccatcaggaggtggacacggggtttgtcctgagccccatcaggaggtggacacggggttttccctgagccccatcaggaggtggacacggggtttgtcctgagccccatcaggaggtggacacggggtttgtcctgagccccatcaggaggtggacacggggtttgtcctgagccccatcaggaggtgaacaccgggttttccctgagccccatcaggaggtggacacagggtttgtcctgagccccatcaggaggtggacacggggtttgtcctaagccccatcaggaggtggacacggggttttccctgcacaccatcaggaggtgaacaccgggttttcactgagctccatcaggaggtggacacggggtttgtcctgagccccatcaggaggtggacacggggttttccctgagccccatcaggaggtggacatggggttttccctgagccccatcaggaggtggacactcggtttgtcctgagccccatcaggaggtggacaccgggttttccctgagccccatgaggaggtggacactcggtttgtcctgagccccatcaggaggtggacactcggtttgccctgtgccccatcaggaggtggacactcggtttatcctgagccccatcaggaggtggacactcggtttgccctgtgccccatcaggaggtggacactcggtttctcctgagcctcatcaggaggtggacacggggttttccctgagccccacactcggtttgtcctgagcgccatcaggaggtggacactgggtttgccctgtgccccatcaggagatggacgctcggtttctcctgagccccatcaggaggtggacacggggtttgccctgagccccatcaggaggtggacaccgggtttgccctgagccccatcaggaggtggacattcggtttgccctgagccccatcaggaggtggacaccgggtttgtcctgagccccatcaggaggtggacattcggtttgccctgagccccatcaggaggtggacaccgggtttgtcctgagccccatcaggaggtggacacttggtttgccctgtgccccatcaggaggtggacacttggtttgccctgtgccccatcaggaggtggacaccgggtttgccctgagccccatcaggaggtggacaccgggtttgccctgagccccatcaggaggtggacacggggtttgtcctgagccccatcaggaggtggacactcggtttgtcctgagccccatcaggaggtggacaccgggtttgccctgtggcttcttgattcattttcagttttttcccagagagcaggtcctcgggatgccagcttttgtggcgggggtggagtaaggtgcttcccccggccccagttgcgcggcggtcttcacacgggcggtctcggcattgcccgcggcctggctttggtccagcagtgagcagcctttgggcagctttcctgattcttgtttgctcaggagacccacaggctcctccgtgatgagaactaggttggtctggcttctacttgtagccagggatcagtgattcagagcagcttttccctgaagacagacgaagaagctgggcccccaggagctcacaggatagggccaggcccaggctgcagcctggagaggcctataacctgcaggaacgggcgggccttgccaactctggcctggggtgttggctgttctggaagaagtagctgagaggctgaatttggctttggtggcatcactggcctgctgggtgtggggccctgccgggatatccatggcctgaaaggtgacatctggagtgagggtgacctggactctgacgcgccacacgatcggcacccagcctgctgatgtccaggaaaccttgaatctggatttttggggaccccgcactgccggccccaggtgcctggcaaaagaagtaagacggcccctttagaggaagacagcgtcagccgaggcctcgggtcatttctacaaatcaccatctggtgcggggtccatcacatgcaaacagaggtaaccaggcagtcaaggagatgcgcaaaacgcagaagccagggaagcagtgccacccgcaggagctccccgtgctgcccacgagccgatcaccccagcccagcccccaggaggctgggccagacaccgacgaagagctgatgactctggaacggggcgtagcagcgttaggggagaaaatgagatgcggatctgagaaaacggcgaagctgatcggtggaactgaggggcgggtttaccagctgaccaggcggcagcggacaggagggaaggagagaacgcgggagagggcgagatgaggaagggtcgctcttgcagaaacttcagaacaggagagggaaggggttggaagtgatgatgacagcaaaaccctttccaaaatggacggaagaaaatctgatgttaaaaatgcgcgtggtctgccgggagcgtctgctggggcgttcgctctggaagattcttcatggtttctcacacgggtagatgcgtgcttgtaatgcagcccagtggccacactcctttatcccggagactcggaatgcgcgtccacacacagacctgcacgtcatgctccctagcagcttaactcaccatagcccaaaccagaaggacgccccccaccggctgtccttcagtgggtgagtggccaggcaaatgctggccacctccctcggtgtcctcctcagcaacaggcatgaacgctgggtccctgccacaccctgggtgatctcggcagcatgatggcgagtgaagaagctggtttcaaggggtgcacactgtatgatctcttcatccccaggtgataggattagcgtgacggaaacagtggcccggggtgtaggtgggggggccgccggcaggccggtgtctggaatcggcacatgggcacgttggcacgtcacgtgggcatgtccacacgcatgcaaggggctgtgggtgaactgcccgtggtgcacacctgagggagttgtgtggcaccagctcggtttggacagtgccctttgttaggtacggttttctcattgggaagctggatttgtattaaagatgcacacgtaagaataaaaaagaggctcgtagaaaa

SEQ ID NO: 122949 - DNA, 774 bp, Homo sapiens
  Payload ID: 4141
  Gene Symbol: CTBP1
  Gene Name: C-terminal binding protein 1
  ENST ID: ENST00000510739
  CDS Start-End: 1-437
gcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcaggtgcccccacggccagtgccgcccccctgctcttccctgtccaccatcctgccggccttgacctccagacggcgcctctgccaggccggacacttgcctgtactcaggcctctcgctggccagcagtgggggagtttgccgcccgctgcgggctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctatag

SEQ ID NO: 122950 - DNA, 843 bp, Homo sapiens
  Payload ID: 4141
  Gene Symbol: CTBP1
  Gene Name: C-terminal binding protein 1
  ENST ID: ENST00000506180
  CDS Start-End: 284-843
ccagtgcggcctctccctgaagggactttcgggccctcccgggtcggggcttcaccggtagcaggcagggctttgatattaatgcttaaagggaaagcagagctgagctgtcaggacgttggttagctacaaaccctactcttgttaaaagagaaatggggtcggggaaggggttctccagccctgaacttcccgggccgggcaggacgcggtccctccaggagtcggggctcccccgcctggggacgcactggggcaggcgcgcttctcctctcggggtcccatgtgccgccggctctcggacggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggc

SEQ ID NO: 122951 - DNA, 985 bp, Homo sapiens
  Payload ID: 4141
  Gene Symbol: CTBP1
  Gene Name: C-terminal binding protein 1
  ENST ID: ENST00000515399
  CDS Start-End: 472-985
ggactttcgggccctcccgggtcggggcttcaccggtagcaggcagggctttgatattaatgcttaaagggaaagcagagctgagctgtcaggacgttggttagctacaaaccctactcttgttaaaagagaaatggggtcggggaaggggttctccagccctgaacttcccgggccgggcaggacgcggtccctccaggagtcggggctcccccgcctggggacgcactggggcaggcgcgcttctcctctcggggtcccatgtgccgccggctctcggacgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttg

SEQ ID NO: 122952 - DNA, 856 bp, Homo sapiens
  Payload ID: 4141
  Gene Symbol: CTBP1
  Gene Name: C-terminal binding protein 1
  ENST ID: ENST00000514210
  CDS Start-End: 250-856
cgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggcagcccactcctgctgaccgctgtccttgtcccgccagcgtttggggaatcggacgtttcgggtggtctcggtgaggcggccacacctaggt

SEQ ID NO: 122953 - DNA, 210 bp, Homo sapiens
  Payload ID: 4141
  Gene Symbol: CTBP1
  Gene Name: C-terminal binding protein 1
  ENST ID: ENST00000629223
  CDS Start-End: 1-210
gccccatcaggaggtggacacggggttttccctgcacaccatcaggaggtggacactcggtttgtcctgagccccatcaggaggtggacactcggtttgccctgtgccccatcaggaggtggacactcggtttatcctgagccccatcaggaggtggacactcggtttgccctgtgccccatcaggaggtggacactcggtttctcctga

SEQ ID NO: 122954 - DNA, 3669 bp, Homo sapiens
  Payload ID: 4142
  Gene Symbol: CTBP2
  Gene Name: C-terminal binding protein 2
  Uniprot ID: P56545
  ENST ID: ENST00000309035
  CDS Start-End: 132-3089
aaacccccagttggttgtccctgccgtctcggaagggttagcacacagccaggtctgtttttgatgtatgtaattgaagatttataaagaaaagcttctcctctgcctcatccgcagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgtaccccctgcaggcaggggtggccttgactaacccgggcccctcaaacccccttcacccaggccccagaacagcctactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtaccagaaggtggcccggcgcacaggggcacccatcatcgtgtccaccatgcttgcaccagaaccaagtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcggg

SEQ ID NO: 122955 - DNA, 6939 bp, Homo sapiens
  Payload ID: 4142
  Gene Symbol: CTBP2
  Gene Name: C-terminal binding protein 2
  Uniprot ID: P56545
  ENST ID: ENST00000337195
  CDS Start-End: 401-1738
gggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcaattgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccatccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtgtgtgcgcgcgcgcgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagtttttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattattaataaaataaaagcttatttttgttttgctgtggataatcggtacaaaacgtttccagatctgagacttagatggatcttttaaggtgaaagtagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagcttttggaggaatatgaagacaaagggaaaatcatacaacagatcagagacttggtaggaatgtgacatggaaacctacagctggtatgctaactcatgaaaaggccaaagcaatcaacttttcacatggttttgacctcttggaagttttgtgattaaagtccagtttgctctggttaaatttaaaaagacataaatgggaaatttctcagaaaaaaactaaagaggagcacactagagggtaatttgttagataaaataaaaaacaaatgtcctaataaactgatcctggcaagccacagcttcaaacacatgacaaggtaagtttacttagtcaattatgtacaagctgaaattatacaagttacggtctatgaactttttttcttcatgttgtgattataaacgttttataattactagtatattaaataaaagaccaatacttttataagaa

SEQ ID NO: 122956 - DNA, 2130 bp, Homo sapiens
  Payload ID: 4142
  Gene Symbol: CTBP2
  Gene Name: C-terminal binding protein 2
  ENST ID: ENST00000334808
  CDS Start-End: 206-1747
gtgacaatggcctctcaggctccccagacgcatcagcggctctggattcccaccttgcgcccagcgtggttttcctgtgtggctaccatttaacgaacagcttggatttcttataatcaggcactctctccgataaccatcctgccagcacccctgaaagtgaagttggggtgttcctcactgtgtgtgggcgaccgcctggggcatgagaccaggacttccaggccccacagggttgtgcgctcagacctcaagtaggggccagaagagtgtactgaaacagaaggaatcttgtggaatttggcagttgtaccattttcttagcagaaaacaggagcccaggtgggagccatgtgtgtcgggttcctcgtcaggtgacggtgctgttgcggatctcgcggatgagctgagggggtatccagctttgtgctgcacgcttcctgtccactcatacaggtcgtgggctggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagagga

SEQ ID NO: 122957 - DNA, 2036 bp, Homo sapiens
  Payload ID: 4142
  Gene Symbol: CTBP2
  Gene Name: C-terminal binding protein 2
  Uniprot ID: P56545
  ENST ID: ENST00000411419
  CDS Start-End: 406-1743
cgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttccttta

SEQ ID NO: 122958 - DNA, 578 bp, Homo sapiens
  Payload ID: 4142
  Gene Symbol: CTBP2
  Gene Name: C-terminal binding protein 2
  ENST ID: ENST00000530884
  CDS Start-End: 570-578
aggagcgaggagtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggtttcatcaccttaaatggttttgaaccaatgaaggtgtattcccttaaaaagacggacagcccatcgtgtgaactatagagtttgtggacagatttatattgaatcccccacagcggtccacgccccttgccaacttccttccactatcctggttctgttgttactcctgccgactgcagtgctgttccgtgagcttcttgaatgacatcgtacagtatctccgacgcacaggttcatagtggcgtcatgcacgcagactcctgcaagttcccctaagttcttagaggactgctttgccttttgatctgagagttgcaaagttccataaagaatggccctt

SEQ ID NO: 122959 - DNA, 1918 bp, Homo sapiens
  Payload ID: 4142
  Gene Symbol: CTBP2
  Gene Name: C-terminal binding protein 2
  Uniprot ID: P56545
  ENST ID: ENST00000531469
  CDS Start-End: 288-1625
aaatccccgctctgcgtgctcgtggtggaggctgctggcaatggcctacgtcgtcataccgggcttccttgccctgtccgggggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttccttta

SEQ ID NO: 122960 - DNA, 2014 bp, Homo sapiens
  Payload ID: 4142
  Gene Symbol: CTBP2
  Gene Name: C-terminal binding protein 2
  Uniprot ID: P56545
  ENST ID: ENST00000494626
  CDS Start-End: 384-1721
ggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagatggagaaaacaaaggattcagattgaaggactgctcagacaccctccgaagaggtggccctgcctgcgctcctcctggctgcagagtaccccaccagcgcggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttccttta

SEQ ID NO: 122961 - DNA, 580 bp, Homo sapiens
  Payload ID: 4142
  Gene Symbol: CTBP2
  Gene Name: C-terminal binding protein 2
  ENST ID: ENST00000395705
  CDS Start-End: 1-352
tggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggta

SEQ ID NO: 122962 - DNA, 2037 bp, Homo sapiens
  Payload ID: 4143
  Gene Symbol: CTPS1
  Gene Name: CTP synthase 1
  Uniprot ID: P17812
  ENST ID: ENST00000372616
  CDS Start-End: 131-1906
gaaactgaggcttcaagagggttcatagctaataattggcagagccagtgtttgaacccagatgagtttggtttgttgagatacatttatatcatctgtaatttttccttcttccaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggt

SEQ ID NO: 122963 - DNA, 3201 bp, Homo sapiens
  Payload ID: 4143
  Gene Symbol: CTPS1
  Gene Name: CTP synthase 1
  Uniprot ID: P17812
  ENST ID: ENST00000372621
  CDS Start-End: 509-2284
tccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaga

SEQ ID NO: 122964 - DNA, 3629 bp, Homo sapiens
  Payload ID: 4144
  Gene Symbol: CTPS2
  Gene Name: CTP synthase 2
  Uniprot ID: Q9NRF8
  ENST ID: ENST00000359276
  CDS Start-End: 358-2118
gggtgacgggagctgcctgtgctggaggaatcactttttaggcgcttgttttggaccattgcacaaacccgggtgcaaaccccaagctcaccagcgtgagtgagctgggccagcagcagggaggagaggggaaggtgggcgaggagggcgccgcgcaccccgaggcccgtgtgggcggtgggaagatcccgggggcggctttggacagccccggcagcgaccccttccccagcccgacaggtgagcgccaggccagccgcggggtggagcccgccgtgcccaccggccaccctccccggtgctaccaccaccgcgcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttggga

SEQ ID NO: 122965 - DNA, 3526 bp, Homo sapiens
  Payload ID: 4144
  Gene Symbol: CTPS2
  Gene Name: CTP synthase 2
  Uniprot ID: Q9NRF8
  ENST ID: ENST00000380241
  CDS Start-End: 255-2015
aaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttggga

SEQ ID NO: 122966 - DNA, 733 bp, Homo sapiens
  Payload ID: 4144
  Gene Symbol: CTPS2
  Gene Name: CTP synthase 2
  ENST ID: ENST00000455276
  CDS Start-End: 1-398
tgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaataagcttgtcccttgggctggcctcagtagaacacactgaatgcccctccgcatttgatctgcgtgactccctgttcattgggctgttttgtgagttaccgatgctcctggagatgaacttggactgggacttggactgattcacactcagttcttttgaatccacagttctctccattacatttgaaccggttccctgtttaatgtctgtttgcctggtcttagtgactcacaaatgaacttccgagtaggagggcagttatgcacctcagaagcgtatttctctgttccctggcagccccagtgtggggagatggctcgccatttgatatttgctgatctttccactccccataaggttaattctaatttctgtggaactttttcataaattagcatattatataagaataacttattgtttaaaacaaactaaagcctttaattcaatttaataaatgtatcttgagtgccc

SEQ ID NO: 122967 - DNA, 4319 bp, Homo sapiens
  Payload ID: 4144
  Gene Symbol: CTPS2
  Gene Name: CTP synthase 2
  Uniprot ID: Q9NRF8
  ENST ID: ENST00000443824
  CDS Start-End: 745-2505
tcctttgtccgctctctgatggcgccggctccctgcccagcgctgagtcgggtccggccgccagccccgcgctcgcagacctcggctgccgggtgtggcgcggggactggggaacgctggcccgtgcccagtgcggttggagcctgtcccgcgcgtccccgggacgcgcttcttcccgcctccgcccgcgccagcgcccgcacccggatccccacttctcccggccctcgggagccaggagagccctgagatggcgttggcggaagtgaagccccgagcgggggtctgcgaggctggtgatcagcgccggtaacatggcctttctgtcctctccccggtcccagtgcaccccttaaacaacgacccccgcgttttccccgtactagatggttagggcgcatagtgccgaactacgctgctgctacagaatagcttttttgggggcaacataaaaaagaattgtatgtatggtttatatacaacaaaatgtcccattttcagtgtgcaaatcgacgggatttgacaaattatacactcctgtaaccattatcccaaagtgaacattgaccatttccttcaccctgcaaagttccctggtacctcctttctgtcaatccaccccaggccccgcactcaaccccggttctgattgttatcatagcttagctttgactgttctagaacttcatagaacaagatcatcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatacc

SEQ ID NO: 122968 - DNA, 4586 bp, Homo sapiens
  Payload ID: 4145
  Gene Symbol: CTR9
  Gene Name: CTR9 homolog, Paf1/RNA polymerase II complex component
  Uniprot ID: Q6PD62
  ENST ID: ENST00000361367
  CDS Start-End: 427-3948
accaagcggctacgccttccaagttttcattcggggccgcgccagcgctgaggagagtcagacgccagatggttccgaaggtcctgcaggctctcggggcaccctacagccgacacgccaacaaaagcttcggagccgccaaccccaaaacggaaacaccggagccacaagctgagctcgcgtagggcacgctcccccgggagtgcttccgggacagggggcggggtcgccggaagtggccgtccgccgtccgctgctcgttgtttaagcggctgacgggaaggagaagccagagctccagcggcgccgcggggcggcagtcaagaccagagccggagccgtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttaccaac

SEQ ID NO: 122969 - DNA, 902 bp, Homo sapiens
  Payload ID: 4145
  Gene Symbol: CTR9
  Gene Name: CTR9 homolog, Paf1/RNA polymerase II complex component
  ENST ID: ENST00000524523
  CDS Start-End: 1-902
gacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaat

SEQ ID NO: 122970 - DNA, 7021 bp, Homo sapiens
  Payload ID: 4146
  Gene Symbol: CTC1
  Gene Name: CTS telomere maintenance complex component 1
  Uniprot ID: Q2NKJ3
  ENST ID: ENST00000315684
  CDS Start-End: 9-3662
ggcgcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagcttcgtctcagtacaggacctcaagactcaccagcgtctcccatgctgcagccacctgtcgtggagcagtagtgcataccaggcctgggcccaagaggctggaccaaatgggaaccccctgccccgagagcagctgttacttttagggacactaacagacctatcggcagacttggaacaagagtgcaggaacggaagcctctatgtgagagataacactggcgtcctgagctgtgagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcagaaacaagctcagaggtgtgcagcgaaacctggctgggagtctagttcgattgagtgctctggtgaaaagtaaacagaaagcttacttcatcctgtctcttggtagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcgggagcagtcactggcgtgttgaatgagcccgctggcctctatgagctggatgggcagctggggctctgccttgcctaccagcagttccgtggccttaggcgggtgatgcgacctggagtgtgtctgcagctccaggatgttcacctgctccagtcagtgggaggggggacaagaaggccagtgctcgccccctgcctccgtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcatagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcattcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttctcactggtactcatctctggggtcccaggcctcctgactcctagttgtccacctcctaggaactcctagtcgttcatcatcatttcagccctttgccgccagggccaaaggtggaaagtgatttggaagagaagagcttttcgtccagcagaagaaatggtaccaaaatcagtctgtaaaggaagtaaattggggagttggcggcaaggcagagagcatagctatgatggtctcagtcagtaaggctgggccctgcaggaagtcaaatatgaatgcctagaggtgttcacaagcacaaagaaggtgtagggggaggcaagtgccaggcacaagcaggggcaggtgaggactctgggtgactgtgctatagggccccaggctacggttagccctgtaggtttcccaagggcctggcctaaggcagatccttgatcgatataccttgagaccagaaggtgctccgaaatcacaaccgtacaattaggggatctaggaacaattctttggagataccaatgcctttggctggtgttgctgcatttctttactggggactgatagatggagaggtggaaagatgagctgaggcacatctttcagagctactgggaggccatttcttcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaattatattgcacctactgcttcctattccctgaatcactagcgctcccgaaggcttggagggaggagtctctgggcacccgggtgaaaggaaggttcacgtgcaaccgccgcgtctttttttccctgaagcgctttcatggaggcagatgtttgtcagtcaagggaagtaagaaaggcattggatgaaaacgaagccctaagcctcgtagtcgtggccgagtggttaaggcgatggactagaaatccattggggtctccccgcgcaggttcgaatcctgccgactacgtcatatttttttcttcagcatactgaccatatttctctccaggatgggatgatccagtcggcaccctccaaacctctcatctaggaactctagaatcgagaatttgatttagagtctatgattttggtttgaaatctatgattaacgtctttggacattgaaggaaatccgaggaatggacaagtgatgcaagagccagttgagttaccaaattagttctagaaagatctgaaaaagctcggtccgggttcctagctctatattcttgtagatgaatttcaggaacctttatggcagcttcggcgccgtggcttagttggttaaagcgcctgtctagtaaacaggagatcctgggttcgaatcccagcggtgcctttattcaattgaaacagcgtgattttgcggctaaatccacatcctttcatgtattgtttttatatcagaacgcgtaagagtttctgttctgcactcatagcacccacatttcctgcagagtcaagctgccactcccatgagatcgccactctaaaaggtggttctctaacttaggggcagaaatgttgcataggcctaagggtcctttgcttaactgatgccacaccccactggtgcaggtggactgggtcaggcggccgccccaccctcgatggaaggggctgcccaccttccaggcctctttctccaccctaggacgtcccctagaacctgagccactttgttttgtttggctcttcattatagttctttgggtttggtggctcataatgttatatatatagtatataatataaaaatatatatttaaatatacagtatttaaaatttggcacagcttccagatgcggtcctctaactggtctttcacttgcagttacctccatccctctccaccagcgggatgtcagggtaaggagtaagcagggatccggctggcctggcctggcctggcaccaggtttcgtgcagcagggtgcagaagggctgaggccatgtgaacagagtccaagaaagcatcattcgggagtcgctagggatcctggtgtggaagggcagggcacttttctggagcactgaagctaggctggttaaggaagaaataaatgccagagataaggcaagaaataggatctgtgagctcttggcaggacctaaacctccttggaagataggcagaaagctctcgacaccattccatggcccacgaaccaatgtaagatgagcaaatggcttgaaggaattgctacctccaggtcaagccagggatgcagcactgccgagaccacgtttgtgccaagcactgggctggaccctgtgcagaaccaaatgaacaaggcacgttcccctttcagcactaacggcactgtaagaacagggagaagtggaatctaatctggcctgagggtagagggtgatcagctaagtctgaaacaccatgtagaaacttgccatgtatggccgggcgcggtggctcacgcctgtaatcccagcgctttgggaggccaaggtgggcggatcacgaggtcaggagttccagaccagcagcctggccaacatagtgaaacctggtaacatagtgaaacctcgtctctactaaaaatgcaaaaaattagccaggcgtggtggcaggcgcctgcagtcctagctacttgggaggctgaggcaagagaatcgcttcaaccttggaggggggaggaggtgttgtcagccgagatcgcgccactgcatcccagcctgggcaacaagagtgaaactccgtctcaaaaaaatgaaataaaataaacgaatgatca

SEQ ID NO: 122971 - DNA, 4797 bp, Homo sapiens
  Payload ID: 4146
  Gene Symbol: CTC1
  Gene Name: CTS telomere maintenance complex component 1
  Uniprot ID: Q2NKJ3
  ENST ID: ENST00000449476
  CDS Start-End: 7-3102
cgcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagcttcgtctcagtacaggacctcaagactcaccagcgtctcccatgctgcagccacctgtcgtggagcagtagtgcataccaggcctgggcccaagaggctggaccaaatgggaaccccctgccccgagagcagctgttacttttagggacactaacagacctatcggcagacttggaacaagagtgcaggaacggaagcctctatgtgagagataacactggcgtcctgagctgtgagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcgggagcagtcactggcgtgttgaatgagcccgctggcctctatgagctggatgggcagctggggctctgccttgcctaccagcagttccgtggccttaggcgggtgatgcgacctggagtgtgtctgcagctccaggatgttcacctgctccagtcagtgggaggggggacaagaaggccagtgctcgccccctgcctccgtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcatagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcattcccctgccccacatctacctggctgaacttctgcagggtggtcagtccccattccaggccactgcctcttgccatatcgtctctgtcttcagccttcagctcttctgggtgtgtgcttattgtaccagcatctgccggcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttctcactggtactcatctctggggtcccaggcctcctgactcctagttgtccacctcctaggaactcctagtcgttcatcatcatttcagccctttgccgccagggccaaaggtggaaagtgatttggaagagaagagcttttcgtccagcagaagaaatggtaccaaaatcagtctgtaaaggaagtaaattggggagttggcggcaaggcagagagcatagctatgatggtctcagtcagtaaggctgggccctgcaggaagtcaaatatgaatgcctagaggtgttcacaagcacaaagaaggtgtagggggaggcaagtgccaggcacaagcaggggcaggtgaggactctgggtgactgtgctatagggccccaggctacggttagccctgtaggtttcccaagggcctggcctaaggcagatccttgatcgatataccttgagaccagaaggtgctccgaaatcacaaccgtacaattaggggatctaggaacaattctttggagataccaatgcctttggctggtgttgctgcatttctttactggggactgatagatggagaggtggaaagatgagctgaggcacatctttcagagctactgggaggccatttcttcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaattatattgcacctactgcttccta

SEQ ID NO: 122972 - DNA, 375 bp, Homo sapiens
  Payload ID: 4146
  Gene Symbol: CTC1
  Gene Name: CTS telomere maintenance complex component 1
  ENST ID: ENST00000580299
  CDS Start-End: 1-375
cctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcattcccctgccccacatctacctggctgaacttctgcagggtggtcagtccccattccaggccactgcctcttgccatatcgtctctgtcttcagccttcagctcttctggtcttcagccagggttgacgagcccatgaccatgttcctctggacactttgtactagcccctctgtcctccgtcctattgtg

SEQ ID NO: 122973 - DNA, 569 bp, Homo sapiens
  Payload ID: 4146
  Gene Symbol: CTC1
  Gene Name: CTS telomere maintenance complex component 1
  ENST ID: ENST00000581729
  CDS Start-End: 1-371
gtggtcagtccccattccaggccactgcctcttgccatatcgtctctgtcttcagccttcagctcttctgggtgtgtgcttattgtaccagcatctgccggcagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccc

SEQ ID NO: 122974 - DNA, 943 bp, Homo sapiens
  Payload ID: 4146
  Gene Symbol: CTC1
  Gene Name: CTS telomere maintenance complex component 1
  ENST ID: ENST00000578537
  CDS Start-End: 1-404
tgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcatagctcctggccccgcttttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccaggtcctgagttttccccctgagaccaccatcagcattcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagc

SEQ ID NO: 122975 - DNA, 5897 bp, Homo sapiens
  Payload ID: 4147
  Gene Symbol: CTTNBP2NL
  Gene Name: CTTNBP2 N-terminal like
  Uniprot ID: Q9P2B4
  ENST ID: ENST00000271277
  CDS Start-End: 226-2145
gcccccgccgggcggctgagggggcggagcctcagccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaggtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataaatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatcttgctgtttggggggaaatagtcttgtttgtacaaagtgaaaaatggcacaatttgggcatattttgttgggaagagggggtggtgtagagggagcacttgactgtggctttgacaaaacaaatgaagtcaatgacccatccaggttagactccataaggaactaagacattgattttctttagagtcttagagctggaaaaagcctttacaataatccagtctgtgattttttaaaccttttggtggttctggacctttttgagaatcttagaaaagccatggagtttatccctagaaaaatgaatatgcctatatgcaaaatttgtttgatggcttcataggatccaaagaccctgaagccatccatggctcatgtatttctgcttaagaaagcataatcttgttctgctctctcattttacaaatgattaatgcatcccttttcaactactccagcgctgttgctgctgcaatgttagcaaatgcaagccagagagaagcacttgaaaatcctttgatgtctaaaaaatgttcaaatagtgtggatgtttacatatctgaagttttcagcatttaagcaaattaatgatcatttcaacaaatactagcatatccggtttcccttaatagcctgtcagcagtgctgccttgtcaatttgtgtgtgtgtgtgtgtatgtgtgtgtgtgtgtgaattcataaggagtgcttctgatgcttagtccttgaaatggaacttcaactgtctttcaaaacactggcttcaaaataggatgtgttttcctaatgaatcagaagtgggcaatgagcattgttccacaggaataatttttaatttaatttctataaaactagttgagaaatgagagcctgtccacccaccatttgtgtatcagtggccaattcattagtaaaaataaaggaggggaaaggaga

SEQ ID NO: 122976 - DNA, 1014 bp, Homo sapiens
  Payload ID: 4147
  Gene Symbol: CTTNBP2NL
  Gene Name: CTTNBP2 N-terminal like
  ENST ID: ENST00000441739
  CDS Start-End: 201-1014
ctctgacacccctcattcaaaggcacctcccaccccgcacctcagccttggcggagaggactcacagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaaga

SEQ ID NO: 122977 - DNA, 2685 bp, Homo sapiens
  Payload ID: 4148
  Gene Symbol: CLEC1A
  Gene Name: C-type lectin domain family 1, member A
  Uniprot ID: Q8NC01
  ENST ID: ENST00000315330
  CDS Start-End: 64-906
acagtagcccggcggcccagggcaatccgaccacatttcactctcaccgctgtaggaatccagatgcaggccaagtacagcagcacgagggacatgctggatgatgatggggacaccaccatgagcctgcattctcaaggctctgccacaactcggcatccagagccccggcgcacagagcacagggctccctcttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtgaagtgtgtgtgattttacaatggacttatggttggtgggaaaattcagcatggaaatgcttttcaaaatatgatagcggtcattattttgattgtgccttactgaaagtttttggggaatttacaagagtactgattacatgattatctggagaaaataagatgtctttgaaatacgtgttggcttcaagaaaacagttttaacgttttcctaaaatgaaatcttttgaggtgagcttatggcatcaacacatggttgatgaggaagctgagttgcattagtgcacatgatttccagtcaggtcatgggaaatgaacagagacagtgacatctttgtagctgctcctttgtgaggcacttctttcttgagacgactccatgcacaaatataacagggatcattgggaatgacaccatcacagccaccaagtttattggtttactgataaatcaattttgagggttttatgctagaaaagataacattataaatctttgtttttcaacagtggaaactgaggtgcttcagttttgtttttcataaacatctatctcatggtaaaatgacgtatagtagcaatcatatgatagaaagaacacattggtgctcattttcataaacttcattttgttagattgtcacttagcaaagactattgcggattcttccttgagaactttcctttcaattttctgttgatttccttaaaattttcttcagggtcgagcaagttctgttgatatattgtgtcatgcaaagaaaactgtatttgtggttagaaaatgaagattttagacctcttattctgatttacttattaggcaagtcactttacttcatgaaacctatttcactgcatatgaagtagaaataattataatttcctcataatgttactgttagctgaaataaagtaaatgtgaaatca

SEQ ID NO: 122978 - DNA, 562 bp, Homo sapiens
  Payload ID: 4148
  Gene Symbol: CLEC1A
  Gene Name: C-type lectin domain family 1, member A
  ENST ID: ENST00000414501
  CDS Start-End: 352-562
aaagcgccttgggctcggctgtgctccagctcgcgctgctgaggtctggcctccgccagctgacttcaactgcaactgcaactcctcctcctcagccgccgcctcagggaacccaccgacccacaaaccagctcccgcaggggcggtgccgctgcctccttttcgttttctgtttttgtttttgttgtgttttttgtttttgttttgttttgtttttggagatgggatctcgctctgttgtccaggctggagtgcagtgacacaatctcagctcactgctgcctccgcctcccaggttcaagcgattctcctgcctcagcctcctgagtagctgggattacaggaatccagatgcaggccaagtacagcagcacgagggacatgctggatgatgatggggacaccaccatgagcctgcattctcaaggctctgccacaactcggcatccagagccccggcgcacagagcacagggctccctcttcaacgtggcgaccagtggccctgaccctgctgactttgtgcttggtgctgctgatagggctggcagccctggggcttt

SEQ ID NO: 122979 - DNA, 1686 bp, Homo sapiens
  Payload ID: 4148
  Gene Symbol: CLEC1A
  Gene Name: C-type lectin domain family 1, member A
  ENST ID: ENST00000457018
  CDS Start-End: 93-836
ttttagtgccttgcttcctgaactagctcacagtagcccggcggcccagggcaatccgaccacatttcactctcaccgctgtaggaatccagatgcaggccaagtacagcagcacgagggacatgctggatgatgatggggacaccaccatgagcctgcattctcaaggctctgccacaactcggcatccagagccccggcgcacagtttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtg

SEQ ID NO: 122980 - DNA, 1165 bp, Homo sapiens
  Payload ID: 4148
  Gene Symbol: CLEC1A
  Gene Name: C-type lectin domain family 1, member A
  ENST ID: ENST00000420265
  CDS Start-End: 29-595
tttcactctcaccgctgtaggaatccagatgcaggccaagtacagcagcacgagggacatgctggatgatgatggggacaccaccatgagcctgcattctcaaggctctgccacaactcggcatccagagccccggcgcacagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctc

SEQ ID NO: 122981 - DNA, 563 bp, Homo sapiens
  Payload ID: 4148
  Gene Symbol: CLEC1A
  Gene Name: C-type lectin domain family 1, member A
  ENST ID: ENST00000544104
  CDS Start-End: 107-307
acattaggaatgccttttagtgccttgcttcctgaactagctcacagtagcccggcggcccagggcaatccgaccacatttcactctcaccgctgtaggaatccagatgcaggccaagtacagcagcacgagggacatgctggatgatgatggggacaccaccatgagcctgcattctcaaggctctgccacaactcggcatccagagccccggcgcacaggctggagtagagtggcacgatcacgactcactgcagccttgacctccctggctcaagcaatcctcccacctcagccttctgagtagctgcgactacagagcacagggctccctcttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaa

SEQ ID NO: 122982 - DNA, 952 bp, Homo sapiens
  Payload ID: 4149
  Gene Symbol: CLEC1B
  Gene Name: C-type lectin domain family 1, member B
  Uniprot ID: Q9P126
  ENST ID: ENST00000298527
  CDS Start-End: 181-870
ctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcatctccgttggctctgcatcctcctcctggtggcgtgtgatggctttgattctgctgatcctgtgcgtggggatggttgtcgggctggtggctctggggatttggtctgtcatgcagcgcaattacctacaaggtgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaa

SEQ ID NO: 122983 - DNA, 869 bp, Homo sapiens
  Payload ID: 4149
  Gene Symbol: CLEC1B
  Gene Name: C-type lectin domain family 1, member B
  Uniprot ID: Q9P126
  ENST ID: ENST00000348658
  CDS Start-End: 201-791
gtccatgtatctctgagcagctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcatctccgctgtcatgcagcgcaattacctacaaggtgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctg

SEQ ID NO: 122984 - DNA, 783 bp, Homo sapiens
  Payload ID: 4149
  Gene Symbol: CLEC1B
  Gene Name: C-type lectin domain family 1, member B
  ENST ID: ENST00000398937
  CDS Start-End: 1-291
ttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgaaaacccaaatcatgatattttgaagatcagagatgtggctctccgtcattttggcatcccactgggccgggatctgtatttcactgagaatgctctgctgcacaaactatacaagcccccttccctctaggcccagctactgtcacagaagaggagggggcagaagattgtaagggctggttttaaagaaaaaaattaggtcaaggtcaaacctccaaatcaaggaggggttacaaaaatgcctaaacagctggtaaaacaagtttagttgctttctaaacgattatgtgtcacttttgcatctaccccaaccatgaaaatttatttgcttattatagaattacaggaaaatatttactaacaggataaaaaataccttgtaacaaagcctcttgggtataatactcccagttatgagttatggagataaacatatctatctatatattttttttcagaacaatgcttatgtttgcatagctaattgctgtatgtctttaacaaaagccaagctt

SEQ ID NO: 122985 - DNA, 3054 bp, Homo sapiens
  Payload ID: 4149
  Gene Symbol: CLEC1B
  Gene Name: C-type lectin domain family 1, member B
  Uniprot ID: Q9P126
  ENST ID: ENST00000428126
  CDS Start-End: 271-861
gagatggttcaactctcttacttggttatttccatctcggttattccttgctccagcagaatcctgaaatgtccatgtatctctgagcagctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcatctccgctgtcatgcagcgcaattacctacaaggtgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaattgcttatttctccctttcttctcactggagttatttttaatattatctttcctatcagaattacctagtcccttctttgaatatacagaagccatcacgtgagtttatcatttgcttcccaattgttctattttcctttaattttctttcttcttgtccttcatttctaattacctgaacatggtatgatttactgcatcttcagatatacacatataacatcaaaatcaggccaatataggttagggcttaattaatataagttgtgcaaaatatctatgtttgaaatctgtccaaaatatctaagtttgaaaggcggtgtaagatagtaaaaagaatattaaacttagaatcagcaaaataatttagatgtcaattaactaaattacaatcatgaacaagtttcataacctctttaacttcccttttctcatatttaaaataggaataataacaaccatcttttatatctcacagttctacaacctaaaatagaactttagagtgttaactgtaccagaaactccatgaaagcgaacactatgacttccccattcactattctcttaccagcaccaacccgaaaccctggctcacaaaacagagagatatttgtttctctttgtataagatagttcatgagaaaaatagctcaatcattaaaacattacgcaaatagaattactattccaagtctacctctggttagattcaacagtagtaattttctgcgctagagaaggaaaagaaagtttgcaagaaaactcactgggtttgtaaaatgaataaatgcttcttaagtttcagaggctactagacagaaggacaagtaaaaatgctttaattagtattttcctaacagttctgtgctttatttttgctgagtaactcaggaagtatttacagaatatgtggaaaggcacccttttacaggataataggaaaaaattgcatttctttcccacagcttcccttttttaactagtggctaccatttacgaacatgattctcaaacatctcaacggaggttttggttaaaacatagagaaaccaaataggaaactcaaatgctgatgttactcagtgggaagactgaggagacacagagacctgggtttttaccagcatcacgacacaattctcatacaagtagtctttaatacagttagagaaatatcactactttagaacttactctctatctggctttggataagtaatgttctcaccttgaaatgggtttaatattattaccttgctcataagttaattgtgaagctcatttaatatgattatataaagtatcgatcagaataccaagtatgtaatacatactcaataaatatgtgttactcttaaagctttgtgcgctaacactgaaagacacttgaatctttatcttttttctagcctatcaataattaagcagatttggagggcttaggaaaaataatagaaatacctcaaattttacttgttacttcaaatgtctggagatcttggatttgggtgatggtatcagtatgttttttattttgaattgtctatttagagaaactaaataggaaccaataattcagaaaactgtacaaaattagcaactcaactttgtttcatctccctaaaatggaaaaacatatgtgtatacatccctatagcacacataaacttagaagaataatatcttagtgcatggcaacaatacaattaaaaatgtaggccaatcactgtgattctttttctggtattcatatctaaagtatcttatacataaaatcaaaatagcacaaacgttagtagcacagatcagaccacctcatttcaaatactaaatcttctacatgtcatctaagtgaactccagcaaaatttgacttctgtcttcttcaatttaaaactaacttacaggcatgcctcggaaatattgtgggttcagttccagaccaccacaataaagcaattattgcaataaagtgagtcacattaattatttgctttcccaattcgtgtaaaagttatgtttgagctacaacgtcttctattaagtatacaacagcattatgtctggaaaatgtacatagttttattaaaaatagtttattgctaaaaa

SEQ ID NO: 122986 - DNA, 1797 bp, Homo sapiens
  Payload ID: 4150
  Gene Symbol: CLEC10A
  Gene Name: C-type lectin domain family 10, member A
  Uniprot ID: Q8IUN9
  ENST ID: ENST00000254868
  CDS Start-End: 330-1280
aaacccaactctccccacccacacatggtctctgtgtgttctaatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctctgctctgggccctgccatctcctgctgtccctgggcctcggcctcctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcaggggtatctgagctccaggaacacactacgcagaaggcacacctaggccactgtccccactgcccatctgtgtgtgtcccagttcattctgaaatgctcctgcgagtccagcagctggtgcaagacctgaagaaactgacctgccaggtggctactctcaacaacaatgcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagtagagatgactttgacaaatatgcatgcctaggtgactaccactccgatcgcaatagataacattgccatcgcccccaccagtcccctcatgcctctgggcagtccaaccacttccctgtttccaggccagtgatctacttctttttcactatttattggccttgcctcttctagagcttctagaacttcatataagtgaaatcatacactctcgtgtatatacttcatataagtgaatatatactctcgtgagaactta

SEQ ID NO: 122987 - DNA, 1646 bp, Homo sapiens
  Payload ID: 4150
  Gene Symbol: CLEC10A
  Gene Name: C-type lectin domain family 10, member A
  ENST ID: ENST00000416562
  CDS Start-End: 289-1158
taatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctctgctctgggccctgccatctcctgctgtccctgggcctcggcctcctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatgcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagtagagatgactttgacaaatatgcatgcctaggtgactaccactccgatcgcaatagataacattgccatcgcccccaccagtcccctcatgcctctgggcagtccaaccacttccctgtttccaggccagtgatctacttctttttcactatttattggccttgcctcttctagagcttctagaacttcatataagtgaaatcatacactctcgtgtatatacttcatat

SEQ ID NO: 122988 - DNA, 1800 bp, Homo sapiens
  Payload ID: 4150
  Gene Symbol: CLEC10A
  Gene Name: C-type lectin domain family 10, member A
  Uniprot ID: Q8IUN9
  ENST ID: ENST00000576617
  CDS Start-End: 271-1041
atttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctctgctctgggccctgccatctcctgctgtccctgggcctcggcctcctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatgcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcaggtgagggcttctggtactcagttcctaagacatgtcccatttagggaaatggttcttaagcttggccgcacattggaatcatctgggagcttccagaatgactgtcatctgtgccacaccctcagagatttaataggcctgagcatccagagaaacatctccaaactcctcagttgatttaacgaagagctaaagttgagaatcactagtttaaggagttggctgggatgggaagaagtcaccactgcccttctgtcaccgcagaattttgtccagaaatatctaggctccgcatacacctggatgggcctcagtgaccctgaaggagcctggaagtgggtggatggaacagactatgcgaccggcttccagtgagtgcaccctggctttctgtgccaatgtcctccgtcagcgtttcccccagggatctgactggcagcctctcctcccctgaactgaattctactccatctacccttcctagcttgctgttgtcttttcctctcaggaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagta

SEQ ID NO: 122989 - DNA, 1442 bp, Homo sapiens
  Payload ID: 4150
  Gene Symbol: CLEC10A
  Gene Name: C-type lectin domain family 10, member A
  Uniprot ID: Q8IUN9
  ENST ID: ENST00000571664
  CDS Start-End: 306-1184
atggtctctgtgtgttctaatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctctgctctgggccctgccatctcctgctgtccctgggcctcggcctcctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatggtgaggaagcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagt

SEQ ID NO: 122990 - DNA, 742 bp, Homo sapiens
  Payload ID: 4150
  Gene Symbol: CLEC10A
  Gene Name: C-type lectin domain family 10, member A
  ENST ID: ENST00000576549
  CDS Start-End: 1-410
gcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatgcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcaggaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagta

SEQ ID NO: 122991 - DNA, 1419 bp, Homo sapiens
  Payload ID: 4151
  Gene Symbol: CLEC11A
  Gene Name: C-type lectin domain family 11, member A
  Uniprot ID: Q9Y240
  ENST ID: ENST00000250340
  CDS Start-End: 198-1169
cacacagagaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgagggg

SEQ ID NO: 122992 - DNA, 1026 bp, Homo sapiens
  Payload ID: 4151
  Gene Symbol: CLEC11A
  Gene Name: C-type lectin domain family 11, member A
  ENST ID: ENST00000599973
  CDS Start-End: 4-957
ttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggaggactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcg

SEQ ID NO: 122993 - DNA, 1128 bp, Homo sapiens
  Payload ID: 4151
  Gene Symbol: CLEC11A
  Gene Name: C-type lectin domain family 11, member A
  ENST ID: ENST00000617718
  CDS Start-End: 140-877
gagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggc

SEQ ID NO: 122994 - DNA, 1549 bp, Homo sapiens
  Payload ID: 4152
  Gene Symbol: CLEC12A
  Gene Name: C-type lectin domain family 12, member A
  Uniprot ID: Q5QGZ9
  ENST ID: ENST00000304361
  CDS Start-End: 183-980
tttgcagacatatgggtgattggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatgaggcatcaatcaaatacatttaaggagtgtagggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagttgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaa

SEQ ID NO: 122995 - DNA, 699 bp, Homo sapiens
  Payload ID: 4152
  Gene Symbol: CLEC12A
  Gene Name: C-type lectin domain family 12, member A
  Uniprot ID: Q5QGZ9
  ENST ID: ENST00000350667
  CDS Start-End: 1-699
atgtctgaagaagttacttatgcagatcttcaattccagaactccagtgagatggaaaaaatcccagaaattggcaaatttggggaaaaagttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatga

SEQ ID NO: 122996 - DNA, 1428 bp, Homo sapiens
  Payload ID: 4152
  Gene Symbol: CLEC12A
  Gene Name: C-type lectin domain family 12, member A
  Uniprot ID: Q5QGZ9
  ENST ID: ENST00000355690
  CDS Start-End: 32-859
ggaagaacagcctttcaaatttgacttctgcatgtggatagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatgaggcatcaatcaaatacatttaaggagtgtagggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagttgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaa

SEQ ID NO: 122997 - DNA, 570 bp, Homo sapiens
  Payload ID: 4152
  Gene Symbol: CLEC12A
  Gene Name: C-type lectin domain family 12, member A
  ENST ID: ENST00000396507
  CDS Start-End: 76-570
tttgcagacatatgggtgattggtacagtaggtttataaacagaagtttaaacttatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaat

SEQ ID NO: 122998 - DNA, 1515 bp, Homo sapiens
  Payload ID: 4152
  Gene Symbol: CLEC12A
  Gene Name: C-type lectin domain family 12, member A
  Uniprot ID: Q5QGZ9
  ENST ID: ENST00000434319
  CDS Start-End: 163-804
tggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgaaaatatcaaacgaagaaagaaaccagagtctcaacctgctggacactattggaagtccatcatttaacacgtttttagtatatacttttagcaggagacagctctgagtcaactgtgttgaggtgccaccacagcgagtttaggcactcagatccctgcatactcatcacattgggccataatggcaaatagaattttttgttttgttttgtttgtttgctttttctttcacatagaaatagtaagtgtaggagtgtgggtcagaaagaaaaggtggccctacctctgatggttggcaatgataggatacaatgggagataagctatctacaaatggagtggagaaggatatatatttcaaaggcctaatttgtagtgaaagactagagacaaaggtaatgtgtgtgtcaggagagagtacagatggaatcttgttttgcaaacgtagaatatgtatgtgtttgtaattattgcaaatggaatggtaatctataatggaatggaaaacattgtagatattttcagttatcaaaaagaaaactgaaaaagtatataataattgtatgtatgatatatatatgtgtgtgtgtgtgtatatatatcttcactttataactctgtgttgttttggggtttgtttctgaaagggggttgtaataaatgacatctgtactatgtcaccacaaataaatctcattcttaaacatttaa

SEQ ID NO: 122999 - DNA, 1097 bp, Homo sapiens
  Payload ID: 4153
  Gene Symbol: CLEC12B
  Gene Name: C-type lectin domain family 12, member B
  Uniprot ID: Q2HXU8
  ENST ID: ENST00000338896
  CDS Start-End: 129-959
agtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacattggggatgatgtttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtgtactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttatttagtactaaagaacttgaccagatcaatggatccaaaggatgtgcttattttcaaaaaggaaatatttatatttctcgctgtagtgctgaaattttttggatttgcgagaagacagctgccccagtgaagactgaggatttggattagtatgcttcttccaaattctccaagaagtaagagacttgtgagtaagctcatatgaggaaagaggaaactacggtaccagagccaaaccagcttttaaaatgactgtgtatttacattatcagacaaatgaacttgttt

SEQ ID NO: 123000 - DNA, 3029 bp, Homo sapiens
  Payload ID: 4153
  Gene Symbol: CLEC12B
  Gene Name: C-type lectin domain family 12, member B
  Uniprot ID: Q2HXU8
  ENST ID: ENST00000396502
  CDS Start-End: 129-827
agtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacattggggatgatgtttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtgtactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgagggtaaacacaagctttccatggaatcctgggaaaattaataatgattgtgagaattataaatacagacataaaaagaggagtacaacatactgagaaaagagctccagtaacaaatattgaaaggaggtatagttcatttcatctctgtgacaaatttatagcaaggcactgaattttatcttttggtagaaatgtgtttatttaacacacacacacacctaatactacattcaaagtattttataaatactaacccttgaagaaagcagttatattcccattttataggtagaaatattataatagagagattaagtaacttgcctgaggtcactcagctcataaattgcactttagggattgtgcactcagtcactcagctattctgactctccagcacctacaatccaaaagggtgctgctggtcataagaacacatatcaacacatttatttatactaaataactgtcaaccattttctaacaaaaagtaagactgaattgactgattagttcaacaattagtgtcatgttgaggacttgccaattacaatatacggcaagtgtcttttatgaattaaaatgaactaaaccttccacttcagggtttggatgaaactatttaaaggacaaatagaatatataacacttggaaaatttcaatttttttaactatttaaagttatgaaaaaatagacgtcaacaaaaatgtgtaaggggatattaggtttgctaaattctttcacagactataaaacaaaaaattttgaggaacacctctcatcataactacatttaaatgaaacaactgtattaatattttaaatataatagtatttttctattagataaaatttaagatctttggcatcttaatggatttttaaactttttattgatacataagagatgtatatgttttggggtatatgtgataatttgatacattcagatagtgtgtaaagatcaaataagtggaattgggatatcgatcactttaaatatttatcttttctttatgctaggagcattcaaattattattttctcattattgtgaaatgtacagtagattattgttaattgtattcaccctaataatctatgaaacactaggtcttacttcttctatctaacagaatatttgtattcataatggctttttatctaccttcctcccccaacaaatcattatccacccccctccctcctgtttcactctttaaagcatgttgtcaacgttttcttaaactgaataataatcactcatcttctgtcaaagatgccatgcttcagctgtgactcagcagttccttaaatcacaaacaatggtaggtctattattttctccctggatacactttatcttcatccatttcccaatgttttgtcatggctatttctactcaaacactaatcccccattctctaatcaccattattaatcatatcaagtcaattagtttggtttcacactaataataatgacaaaaagcacatgcagagtaatacacaaacaaaaaaagtgacagttacttttttgtgacaagagcaatattgggtatgaactgattaatattaatctgaggtgttgctactagactgagggtttccaggagtagtactatgacatcatgtaaacacattcagttttcatgttggaatctaagatgtgtcccttctcccaaagggattttaatcattcttggcctctctactcactcttaatcaaagtgtggaggaggtggcccccacagcagggtttggaacctacagaccctggcccctgagacatgcagctgtcagacaagccagcatgtcaaacacaggttagagagactgagcttccagattgcatagccatttccttgactactgagtaaaggccaaggctaagatttagtaagcctagccctgaagcaagcaaagaatatggcagtgtaatgcaggtcatttagaaaaaaacaatgttgggcacaaagaaaatttagatctgacaagtataattttctaaagacattatttcaggattaacatcaatttcttagcagaggaaatgaatactattgtcagaaccatatctatatagtcaatcatttcctcttttaacgtctgtcttgttctctttttacccaccacatatgtataactatgtgaaaaattatatttgtgcataataaaatgtgataactttttacaac

SEQ ID NO: 123001 - DNA, 1193 bp, Homo sapiens
  Payload ID: 4153
  Gene Symbol: CLEC12B
  Gene Name: C-type lectin domain family 12, member B
  Uniprot ID: Q2HXU8
  ENST ID: ENST00000544853
  CDS Start-End: 134-832
ggggcagtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacattggggatgatgtttttgcagatatctaatgacattaactcagattcagagaaattgagtcaacttcagaaaaccatccaacagcagcaggataacttatcccagcaactgggcaactccaacaacttgtccatggaggaggaatttctcaagtcacagatctccagtgtactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgagggtaaacacaagctttccatggaatcctgggaaaattaataatgattgtgagaattataaatacagacataaaaagaggagtacaacatactgagaaaagagctccagtaacaaatattgaaaggagatttagtactaaagaacttgaccagatcaatggatccaaaggatgtgcttattttcaaaaaggaaatatttatatttctcgctgtagtgctgaaattttttggatttgcgagaagacagctgccccagtgaagactgaggatttggattagtatgcttcttccaaattctccaagaagtaagagacttgtgagtaagctcatatgaggaaagaggaaactacggtaccagagc

SEQ ID NO: 123002 - DNA, 2898 bp, Homo sapiens
  Payload ID: 4153
  Gene Symbol: CLEC12B
  Gene Name: C-type lectin domain family 12, member B
  ENST ID: ENST00000539155
  CDS Start-End: 2-199
aatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacattggggatgatgtatatctaatgacattaactcagattcagagaaattgagtcaacttcagaaaaccatccaacagcagcaggataacttatcccagcaactgggcaactccaacaacttgtccatggaggaggaatttctcaagtcacagatctccagtgtactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgagggtaaacacaagctttccatggaatcctgggaaaattaataatgattgtgagaattataaatacagacataaaaagaggagtacaacatactgagaaaagagctccagtaacaaatattgaaaggaggtatagttcatttcatctctgtgacaaatttatagcaaggcactgaattttatcttttggtagaaatgtgtttatttaacacacacacacacctaatactacattcaaagtattttataaatactaacccttgaagaaagcagttatattcccattttataggtagaaatattataatagagagattaagtaacttgcctgaggtcactcagctcataaattgcactttagggattgtgcactcagtcactcagctattctgactctccagcacctacaatccaaaagggtgctgctggtcataagaacacatatcaacacatttatttatactaaataactgtcaaccattttctaacaaaaagtaagactgaattgactgattagttcaacaattagtgtcatgttgaggacttgccaattacaatatacggcaagtgtcttttatgaattaaaatgaactaaaccttccacttcagggtttggatgaaactatttaaaggacaaatagaatatataacacttggaaaatttcaatttttttaactatttaaagttatgaaaaaatagacgtcaacaaaaatgtgtaaggggatattaggtttgctaaattctttcacagactataaaacaaaaaattttgaggaacacctctcatcataactacatttaaatgaaacaactgtattaatattttaaatataatagtatttttctattagataaaatttaagatctttggcatcttaatggatttttaaactttttattgatacataagagatgtatatgttttggggtatatgtgataatttgatacattcagatagtgtgtaaagatcaaataagtggaattgggatatcgatcactttaaatatttatcttttctttatgctaggagcattcaaattattattttctcattattgtgaaatgtacagtagattattgttaattgtattcaccctaataatctatgaaacactaggtcttacttcttctatctaacagaatatttgtattcataatggctttttatctaccttcctcccccaacaaatcattatccacccccctccctcctgtttcactctttaaagcatgttgtcaacgttttcttaaactgaataataatcactcatcttctgtcaaagatgccatgcttcagctgtgactcagcagttccttaaatcacaaacaatggtaggtctattattttctccctggatacactttatcttcatccatttcccaatgttttgtcatggctatttctactcaaacactaatcccccattctctaatcaccattattaatcatatcaagtcaattagtttggtttcacactaataataatgacaaaaagcacatgcagagtaatacacaaacaaaaaaagtgacagttacttttttgtgacaagagcaatattgggtatgaactgattaatattaatctgaggtgttgctactagactgagggtttccaggagtagtactatgacatcatgtaaacacattcagttttcatgttggaatctaagatgtgtcccttctcccaaagggattttaatcattcttggcctctctactcactcttaatcaaagtgtggaggaggtggcccccacagcagggtttggaacctacagaccctggcccctgagacatgcagctgtcagacaagccagcatgtcaaacacaggttagagagactgagcttccagattgcatagccatttccttgactactgagtaaaggccaaggctaagatttagtaagcctagccctgaagcaagcaaagaatatggcagtgtaatgcaggtcatttagaaaaaaacaatgttgggcacaaagaaaatttagatctgacaagtataattttctaaagacattatttcaggattaacatcaatttcttagcagaggaaatgaatactattgtcagaaccatatctatatagtcaatcatttcctcttttaacgtctgtcttgttctctttttacccaccacatatgtataactatgtgaaaaattatatttgtgcataataaaatgtgataactttttacaacagaa

SEQ ID NO: 123003 - DNA, 2267 bp, Homo sapiens
  Payload ID: 4154
  Gene Symbol: CLEC14A
  Gene Name: C-type lectin domain family 14, member A
  Uniprot ID: Q86T13
  ENST ID: ENST00000342213
  CDS Start-End: 348-1820
ctcctcttgctctaagcagggtgtttgaccttctagtcgactgcgtcccctgtacccggcgccagctgtgttcctgaccccagaataactcagggctgcaccgggcctggcagcgctccgcacacatttcctgtcgcggcctaagggaaactgttggccgctgggcccgcggggggattcttggcagttggggggtccgtcgggagcgagggcggaggggaagggagggggaaccgggttggggaagccagctgtagagggcggtgaccgcgctccagacacagctctgcgtcctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataacccag

SEQ ID NO: 123004 - DNA, 4351 bp, Homo sapiens
  Payload ID: 4155
  Gene Symbol: CLEC16A
  Gene Name: C-type lectin domain family 16, member A
  ENST ID: ENST00000261657
  CDS Start-End: 1-457
caaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagtcaggagtggcaggaaaggacgccgacgagtgttcagcctgtcggaggccgacagtcatggcggccactgggtttagtgctccgaacggcagctgccacggcacctcacgcacagtcaattcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagtt

SEQ ID NO: 123005 - DNA, 3365 bp, Homo sapiens
  Payload ID: 4155
  Gene Symbol: CLEC16A
  Gene Name: C-type lectin domain family 16, member A
  Uniprot ID: Q2KHT3
  ENST ID: ENST00000409552
  CDS Start-End: 138-2858
cggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggtgagccagccccccgccctgcgccacagctcgttcatcatggtgggcgttcaaggtctttctctctgtggagcctgtgtgagctgcccttcctctctcagaagccccgtcggctggcagcaccagcttcttagaatttgtcaaagcacagcgcaagattaaacacagcccccaaaataaattttggctttccctttagtgtttggtttggttttccagagatttgttgggtatgtggaagaacttctcagaattgactaagaattttcttggaaatttcttggaaacatttaaatgattagtgctgaagttgtgggagagtaatttccttctccatgtaagatgactagaaagagagagtgtgtttggttccggttacaaccccctgaagaagtgagacttcaaaagaaggccgtgctgcccacaggtcagctgtccactccttccatatgagggcgtctcctcccacttttgccacagctcatctctaaccctgctcctccgctcctcccaaaacagaaacttgaatggaaagtccattgctgatttgtcagagtggaaaggaccacttctccagaagaccgagttctccccttcctgttctgacatgtctgctttaagtaaatccgtatgcaccccga

SEQ ID NO: 123006 - DNA, 6891 bp, Homo sapiens
  Payload ID: 4155
  Gene Symbol: CLEC16A
  Gene Name: C-type lectin domain family 16, member A
  Uniprot ID: Q2KHT3
  ENST ID: ENST00000409790
  CDS Start-End: 231-3392
aactgcatttcccagcgccccacgcggcggcggccgtaaagcgcggcggtcgaacggccggttccggctgaatgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtgtcattggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaccaagaa

SEQ ID NO: 123007 - DNA, 521 bp, Homo sapiens
  Payload ID: 4155
  Gene Symbol: CLEC16A
  Gene Name: C-type lectin domain family 16, member A
  ENST ID: ENST00000428742
  CDS Start-End: 1-386
acatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggttttcaaggatagtgtttaaaatctgagaggatttatccatggataaagagctataggctaaaagactctgcaagttcccagctatttttgtatgttggacatgttatccgttgaaaagcaatcagaaataaaaagtatttaagcgtt

SEQ ID NO: 123008 - DNA, 486 bp, Homo sapiens
  Payload ID: 4155
  Gene Symbol: CLEC16A
  Gene Name: C-type lectin domain family 16, member A
  ENST ID: ENST00000436973
  CDS Start-End: 1-357
ctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccagccctgctgactgccgcagtagagaggcagcccagatggccgctcccaagcttgctagtgccttggctgacagactgttgtggaggtctttgcttgctaatttacagacggttttcaaggatagtgtttaaaatctgagaggatttatccatggataaagagctataggctaaaagactctgcaagttcccagctatttttgtatgttggacatgttatccgttgaaaagcaatcagaaataaaaagtatttaagcgttgtgaggtg

SEQ ID NO: 123009 - DNA, 1247 bp, Homo sapiens
  Payload ID: 4156
  Gene Symbol: CLEC17A
  Gene Name: C-type lectin domain family 17, member A
  Uniprot ID: Q6ZS10
  ENST ID: ENST00000339847
  CDS Start-End: 39-836
agccctggctgccacttgtcaggttccctgtgctagacatgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccaggttcaagtgctccaccaagacctccaagggcagcaaaggaaacagagaaacccccacttccttgcaagccccggaacatgacaggcctggacctcgccgctgtcacctgtccacctcctcaactggctgtgaatcttgagccttctccattgcagccatccctggccgcaactccagtcccctggctcaatcagaggtctggaggtcctggctgctgccagaagaggtggatggtgtacctgtgtctgctggtggtgacttccctgttcctgggctgccttggtctcactgtgaccctgattaagtaccaggagttgatggaagaactgagaatgttaagctttcagcagatgacgtggcgaacaaatatgactggcatggcagggctagctggcctgaagcatgacattgcccgtgtaagagctgacaccaaccagtccctggtggaactttggggcttattagaattttgtggccaaggcccatggctctccacgggtgtactggctggggctgaatgacagggcccaggaaggggactggaggtggctggatgggtctcctgtgacattaagcttctgggagccagaggaacccaataacatccacgatgaggactgtgctaccatgaacaaaggtggcacctggaatgatctctcttgctacaaaactacgtattggatttgtgagcggaaatgttcctgttgaagcccagggccgaggctgggggtccatatctgagtgtctctttgagatgagaatctcctgccctttcgtggacggccttgcctcttcgtgagtggacacacagatgtgcctcaaacaggattggcaccctggatgcagcaagttcccaggggtgcaagtcaggctgtttctagagtgaggacttgggcttgccctagtagatggtgagctgggaggatgctcag

SEQ ID NO: 123010 - DNA, 1399 bp, Homo sapiens
  Payload ID: 4156
  Gene Symbol: CLEC17A
  Gene Name: C-type lectin domain family 17, member A
  Uniprot ID: Q6ZS10
  ENST ID: ENST00000417570
  CDS Start-End: 39-1175
agccctggctgccacttgtcaggttccctgtgctagacatgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccaggttcaagtgctccaccaagacctccaagggcagcaaaggaaacagagaaacccccacttccttgcaagccccggaacatgacaggcctggacctcgccgctgtcacctgtccacctcctcaactggctgtgaatcttgagccttctccattgcagccatccctggccgcaactccagtcccctggctcaatcagaggtctggaggtcctggctgctgccagaagaggtggatggtgtacctgtgtctgctggtggtgacttccctgttcctgggctgccttggtctcactgtgaccctgattaagtaccaggagttgatggaagaactgagaatgttaagctttcagcagatgacgtggcgaacaaatatgactggcatggcagggctagctggcctgaagcatgacattgcccgtgtaagagctgacaccaaccagtccctggtggaactttggggcttattagactgccgccgaattacctgtcctgaaggctggctgccctttgagggcaagtgttactacttctccccaagcaccaagtcatgggatgaggcccggatgttctgccaggagaattactctcacttggtcatcatcaatagctttgctgagcacaattttgtggccaaggcccatggctctccacgggtgtactggctggggctgaatgacagggcccaggaaggggactggaggtggctggatgggtctcctgtgacattaagcttctgggagccagaggaacccaataacatccacgatgaggactgtgctaccatgaacaaaggtggcacctggaatgatctctcttgctacaaaactacgtattggatttgtgagcggaaatgttcctgttgaagcccagggccgaggctgggggtccatatctgagtgtctctttgagatgagaatctcctgccctttcgtggacggccttgcctcttcgtgagtggacacacagatgtgcctcaaacaggattggcaccctggatgcagcaagttcccaggggtgcaagtcaggctgtttctagagtgaggacttgggcttgccctagtagatggtgagctgggaggatgctcag

SEQ ID NO: 123011 - DNA, 1462 bp, Homo sapiens
  Payload ID: 4156
  Gene Symbol: CLEC17A
  Gene Name: C-type lectin domain family 17, member A
  ENST ID: ENST00000551730
  CDS Start-End: 39-722
agccctggctgccacttgtcaggttccctgtgctagacatgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccaggttcaagtgctccaccaagacctccaagggcagcaaaggaaacagagaaacccccacttccttgcaagccccggaacatgacaggcctggacctcgccgctgtcacctgtccacctcctcaactggctgtgaatcttgagccttctccattgcagccatccctggccgcaactccagtcccctggctcaatcagaggtctggaggtcctggctgctgccagaagaggtggatggtgtacctgtgtctgctggtggtgacttccctgttcctgggctgccttggtctcactgtgaccctgattaagtaccaggagttgatggaagaactgagaatgttaagctttcagcagatgacgtggcgaacaaatatccgtggtggatgggtaggatgggttctcagtctgtagccctcaagcccatcccttctgacagtgactggcatggcagggctagctggcctgaagcatgacattgcccgtgtaagagctgacaccaaccagtccctggtggaactttggggcttattagactgccgccgaattacctgtcctgaaggctggctgccctttgagggcaagtgttactacttctccccaagcaccaagtcatgggatgaggcccggatgttctgccaggagaattactctcacttggtcatcatcaatagctttgctgagcacaattttgtggccaaggcccatggctctccacgggtgtactggctggggctgaatgacagggcccaggaaggggactggaggtggctggatgggtctcctgtgacattaagcttctgggagccagaggaacccaataacatccacgatgaggactgtgctaccatgaacaaaggtggcacctggaatgatctctcttgctacaaaactacgtattggatttgtgagcggaaatgttcctgttgaagcccagggccgaggctgggggtccatatctgagtgtctctttgagatgagaatctcctgccctttcgtggacggccttgcctcttcgtgagtggacacacagatgtgcctcaaacaggattggcaccctggatgcagcaagttcccaggggtgcaagtcaggctgtttctagagtgaggacttgggcttgccctagtagatggtgagctgggaggatgctcag

SEQ ID NO: 123012 - DNA, 2065 bp, Homo sapiens
  Payload ID: 4156
  Gene Symbol: CLEC17A
  Gene Name: C-type lectin domain family 17, member A
  Uniprot ID: Q6ZS10
  ENST ID: ENST00000547437
  CDS Start-End: 78-998
agacgcctgagtcggagagacagggggcagaggttgccaagccctggctgccacttgtcaggttccctgtgctagacatgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccaggttcaagtgctccaccaagacctccaagggcagcaaaggaaacagagaaacccccacttccttgcaagccccggaacatgacaggcctggacctcgccgctgtcacctgtccacctcctcaactggctgtgaatcttgagccttctccattgcagccatccctggccgcaactccagtcccctggctcaatcagaggtctggaggtcctggctgctgccagaagaggtggatggtgtacctgtgtctgctggtggtgacttccctgttcctgggctgccttggtctcactgtgaccctgattaagtaccaggagttgatggaagaactgagaatgttaagctttcagcagatgacgtggcgaacaaatatgactggcatggcagggctagctggcctgaagcatgacattgcccgtgtaagagctgacaccaaccagtccctggtggaactttggggcttattagactgccgccgaattacctgtcctgaaggctggctgccctttgagggcaagtgttactacttctccccaagcaccaagtcatgggatgaggcccggatgttctgccaggagaattactctcacttggtcatcatcaatagctttgctgagcaccttctgggagccagaggaacccaataacatccacgatgaggactgtgctaccatgaacaaaggtggcacctggaatgatctctcttgctacaaaactacgtattggatttgtgagcggaaatgttcctgttgaagcccagggccgaggctgggggtccatatctgagtgtctctttgagatgagaatctcctgccctttcgtggacggccttgcctcttcgtgagtggacacacagatgtgcctcaaacaggattggcaccctggatgcagcaagttcccaggggtgcaagtcaggctgtttctagagtgaggacttgggcttgccctagtagatggtgagctgggaggatgctcagagcttggtggtgggaggtctcccacttctggggttgaaaggatcttcactaagttcctgatcatgactcttgggaagtgatactagccctgaggaccctggggctggtgttgaacctgggatgaaatatcctggcgcctgtgaaccacaaagagctgggactgggctccttttcctgcagcctcaaacttctgggctcaggtgatcctcccatctcagcctcctgagtagctgggactacacatgcgcaccaccatgcctggccaattttttgtagcatttaaagagagggagtctcactatgttgcccaggccagtctcaaactccttgcctcaatggatcctcctacttgggcttcccaaattgtgaggattacaggtgtgagccactgtgcctggctcaaaattattattattatttttatagagatgaggtctcactctgttgccgaggctggtctcaaactcctggggtcaagcaatccttccgtgatggcctcccaaagtgctgggattacaggcatgtgtcaccgtacctggccgatatttttatttttatttttactttccccatcttttccttttttttttttttccaaacaaaagctttgaaagtggtgacagaaaaatttccctttgagctagacctctagatctgcctcgcacagaaatacattaagtgggctggtctcatgtagtccccacatcattgcaaattacaaacctaaaaatacagaa

SEQ ID NO: 123013 - DNA, 2155 bp, Homo sapiens
  Payload ID: 4157
  Gene Symbol: CLEC18A
  Gene Name: C-type lectin domain family 18, member A
  Uniprot ID: A5D8T8
  ENST ID: ENST00000288040
  CDS Start-End: 188-1528
ctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggagctgttctcatggctggggcccaggcaggcagggtattaatagaagttgctctgaa

SEQ ID NO: 123014 - DNA, 1955 bp, Homo sapiens
  Payload ID: 4157
  Gene Symbol: CLEC18A
  Gene Name: C-type lectin domain family 18, member A
  Uniprot ID: A5D8T8
  ENST ID: ENST00000393701
  CDS Start-End: 240-1580
cgaggtcctcctcccagggcccggggctggggagcggaagccatcagtgggctcggaggacactgtcccagccaggacacggccatcggtcactaatctgcagcactggaatgtccgcgggccaatcagcgggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 123015 - DNA, 1875 bp, Homo sapiens
  Payload ID: 4157
  Gene Symbol: CLEC18A
  Gene Name: C-type lectin domain family 18, member A
  ENST ID: ENST00000449317
  CDS Start-End: 135-1502
tcaccagcctccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggctggtgtggctgagtgctgccatggggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctg

SEQ ID NO: 123016 - DNA, 1934 bp, Homo sapiens
  Payload ID: 4157
  Gene Symbol: CLEC18A
  Gene Name: C-type lectin domain family 18, member A
  Uniprot ID: A5D8T8
  ENST ID: ENST00000568461
  CDS Start-End: 219-1559
cggccatcggtcactaatctgcagcactggaatgtccgcgggccaatcagcggggtctctgggggctccccaagggtgctaataatcccacaatgattagcaggggccgcggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 123017 - DNA, 574 bp, Homo sapiens
  Payload ID: 4157
  Gene Symbol: CLEC18A
  Gene Name: C-type lectin domain family 18, member A
  ENST ID: ENST00000561889
  CDS Start-End: 375-574
aaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctccccaccccagccctgaacaggaaggagagtttcttgctcctctccctgcacaaccgcctgcgcagctgggtccagccccctgcggctgacatgcggaggctgctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgctt

SEQ ID NO: 123018 - DNA, 2282 bp, Homo sapiens
  Payload ID: 4157
  Gene Symbol: CLEC18A
  Gene Name: C-type lectin domain family 18, member A
  ENST ID: ENST00000617654
  CDS Start-End: 219-1118
cggccatcggtcactaatctgcagcactggaatgtccgcgggccaatcagcggggtctctgggggctccccaagggtgctaataatcccacaatgattagcaggggccgcggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaaggcagccctctgtggaaccccaaccccgagcctggcgtccggcctgtggcgcaccctgcaagtgggctggaacatgcagctgctccgcgggcttggtgtcctttgtcgaagtggagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggagctgttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123019 - DNA, 2294 bp, Homo sapiens
  Payload ID: 4157
  Gene Symbol: CLEC18A
  Gene Name: C-type lectin domain family 18, member A
  ENST ID: ENST00000620064
  CDS Start-End: 219-1130
cggccatcggtcactaatctgcagcactggaatgtccgcgggccaatcagcggggtctctgggggctccccaagggtgctaataatcccacaatgattagcaggggccgcggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggagctgttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123020 - DNA, 2215 bp, Homo sapiens
  Payload ID: 4157
  Gene Symbol: CLEC18A
  Gene Name: C-type lectin domain family 18, member A
  Uniprot ID: A5D8T8
  ENST ID: ENST00000615430
  CDS Start-End: 139-1479
gactttcctaaggcacccttttcctcgtgcagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccagctggctcaagccagggcagccctctgtggaaccccaaccccgagcctggcgtccggcctgtggcgcaccctgcaagtgggctggaacatgcagctgctacccgcgggcttggtgtcctttgtcgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagatcacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggagctgttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123021 - DNA, 1865 bp, Homo sapiens
  Payload ID: 4158
  Gene Symbol: CLEC18B
  Gene Name: C-type lectin domain family 18, member B
  Uniprot ID: Q6UXF7
  ENST ID: ENST00000339953
  CDS Start-End: 123-1490
ctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctgtggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccggaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggctggtgtggctgagtgctgccatggggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaa

SEQ ID NO: 123022 - DNA, 1847 bp, Homo sapiens
  Payload ID: 4158
  Gene Symbol: CLEC18B
  Gene Name: C-type lectin domain family 18, member B
  ENST ID: ENST00000620745
  CDS Start-End: 135-1046
tcaccagcccccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctgtggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccagaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctg

SEQ ID NO: 123023 - DNA, 2321 bp, Homo sapiens
  Payload ID: 4158
  Gene Symbol: CLEC18B
  Gene Name: C-type lectin domain family 18, member B
  ENST ID: ENST00000617101
  CDS Start-End: 245-1585
atagccgaggtcctcctcccagggcccggggctggggagcggaagccatcagtgggctcggaggacactgtcccagccaggacacggccatcggtcactaatctgcagcaccggaatgtccccaggccaatcagcgggcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctgtggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccagaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123024 - DNA, 2215 bp, Homo sapiens
  Payload ID: 4158
  Gene Symbol: CLEC18B
  Gene Name: C-type lectin domain family 18, member B
  ENST ID: ENST00000619275
  CDS Start-End: 139-1479
gactttcctaaggcacccttttcctcgtgcagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctgtggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccagaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123025 - DNA, 1934 bp, Homo sapiens
  Payload ID: 4159
  Gene Symbol: CLEC18C
  Gene Name: C-type lectin domain family 18, member C
  Uniprot ID: Q8NCF0
  ENST ID: ENST00000314151
  CDS Start-End: 219-1559
cggccatcggtcactaatctgcagcactggaatgtccgcaggccaatcagcggggtctctgggggctccccaagggtgctaataatcccacaatgattagcaggggccgcggcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 123026 - DNA, 1865 bp, Homo sapiens
  Payload ID: 4159
  Gene Symbol: CLEC18C
  Gene Name: C-type lectin domain family 18, member C
  ENST ID: ENST00000536907
  CDS Start-End: 123-1490
ctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggctggtgtggctgagtgctgccatggggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 123027 - DNA, 1955 bp, Homo sapiens
  Payload ID: 4159
  Gene Symbol: CLEC18C
  Gene Name: C-type lectin domain family 18, member C
  Uniprot ID: Q8NCF0
  ENST ID: ENST00000541793
  CDS Start-End: 240-1580
cgaggtcctcctcccagggcccggggctggggagcggaagccatcagtgggctcggaggacactgtcccagccaggacacggccatcggtcactaatctgcagcactggaatgtccgcaggccaatcagcgggcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 123028 - DNA, 1970 bp, Homo sapiens
  Payload ID: 4159
  Gene Symbol: CLEC18C
  Gene Name: C-type lectin domain family 18, member C
  Uniprot ID: Q8NCF0
  ENST ID: ENST00000569347
  CDS Start-End: 255-1595
tctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaa

SEQ ID NO: 123029 - DNA, 836 bp, Homo sapiens
  Payload ID: 4159
  Gene Symbol: CLEC18C
  Gene Name: C-type lectin domain family 18, member C
  ENST ID: ENST00000562923
  CDS Start-End: 434-836
attttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctgctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgct

SEQ ID NO: 123030 - DNA, 518 bp, Homo sapiens
  Payload ID: 4159
  Gene Symbol: CLEC18C
  Gene Name: C-type lectin domain family 18, member C
  ENST ID: ENST00000565806
  CDS Start-End: 161-518
cagcactggaatgtccgcaggccaatcagcggggtctctgggggctccccaaggcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcct

SEQ ID NO: 123031 - DNA, 2215 bp, Homo sapiens
  Payload ID: 4159
  Gene Symbol: CLEC18C
  Gene Name: C-type lectin domain family 18, member C
  Uniprot ID: Q8NCF0
  ENST ID: ENST00000618957
  CDS Start-End: 139-1479
gactttcctaaggcacccttttcctcgtgcagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123032 - DNA, 2291 bp, Homo sapiens
  Payload ID: 4159
  Gene Symbol: CLEC18C
  Gene Name: C-type lectin domain family 18, member C
  ENST ID: ENST00000611662
  CDS Start-End: 219-1127
cggccatcggtcactaatctgcagcactggaatgtccgcaggccaatcagcggggtctctgggggctccccaagggtgctaataatcccacaatgattagcaggggccgcggcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123033 - DNA, 2288 bp, Homo sapiens
  Payload ID: 4159
  Gene Symbol: CLEC18C
  Gene Name: C-type lectin domain family 18, member C
  ENST ID: ENST00000611356
  CDS Start-End: 219-1124
cggccatcggtcactaatctgcagcactggaatgtccgcaggccaatcagcggggtctctgggggctccccaagggtgctaataatcccacaatgattagcaggggccgcggcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggccaactggctcaagccaggcagccctctgtggaatcccaaccccgagcctggcgtccggcctgtggcgcaccctgcaagtgggctggaacatgcagcttgcccgcgggcttggcgtcctttgttgaagtggagcctatggtttgcagaggggcagcggtacagccacgcggcaggagagtgtgctcgcaacgccacctgcacccactacacgcagctcgtgtgggccacctcaagccagctgggctgtgggcggcacctgtgctctgcaggccaggcagcgatagaagcctttgtctgtgcctactcccccagaggcaactgggaggtcaacgggaagacaatcgtcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacaaccagcgctgcaaaacccgaaaccgttacatctgccagtttgcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcag

SEQ ID NO: 123034 - DNA, 666 bp, Homo sapiens
  Payload ID: 4160
  Gene Symbol: CLEC19A
  Gene Name: C-type lectin domain family 19, member A
  Uniprot ID: Q6UXS0
  ENST ID: ENST00000465414
  CDS Start-End: 74-484
cctggacccaagctccagccaaaaagcctctctcctccactcaggctgggaggttgctttctaggagctcaggatgcaaaggtggacactgtgggctgcagccttcctgaccctccactctgcacaggcctttccacaaacagacatcagtatcagtccagccctgccagagctgcccctgccttccctgtgccccctgttctggatggagttcaaaggccactgctatcgattcttccctctcaataagacctgggctgaggccgacctctactgttctgagttctctgtgggcaggaagtccgccaagctggcctccatccacagctgggaggagaatgtctttgtatatgacctcgtgaacagctgtgttcccggcatcccagctgacgtctggacaggccttcatgatcacagacaggtgagaaagcagtggccattgggcccccttggaagctccagccaggattctattttgatttaataagcttttcacatcagtgccaggtcacggctatgcacacagcatatagagagaaatcagacaccaagatgtcacagttacagcatgaccaatttgtgaaagacatttaatgatgtcctactaaatgatgggaacagatagcatggtcagagaaaacctgtttggcttgggttctcttaaaa

SEQ ID NO: 123035 - DNA, 782 bp, Homo sapiens
  Payload ID: 4160
  Gene Symbol: CLEC19A
  Gene Name: C-type lectin domain family 19, member A
  ENST ID: ENST00000476906
  CDS Start-End: 70-267
gacccaagctccagccaaaaagcctctctcctccactcaggctgggaggttgctttctaggagctcaggatgcaaaggtggacactgtgggctgcagccttcctgaccctccactctgcacaggcctttccacaaacagacatcagtatcagtccagtctgtttcctttctgcccccagccctgccagagctgcccctgccttccctgtgccccctgttctggatggagttcaaaggccactgctatcgattcttccctctcaataagacctgggctgaggccgacctctactgttctgagttctctgtgggcaggaagtccgccaagctggcctccatccacaggtcaaatccagagatgcccatgtaggaccggccacatatgggtgacttaatgaaaaatggaggccgaattggatcatatcctctatttactttggtccaggaagctgggaggagaatgtctttgtatatgacctcgtgaacagctgtgttcccggcatcccagctgacgtctggacaggccttcatgatcacagacaggtgagaaagcagtggccattgggcccccttggaagctccagccaggattctattttgatttaataagcttttcacatcagtgccaggtcacggctatgcacacagcatatagagagaaatcagacaccaagatgtcacagttacagcatgaccaatttgtgaaagacatttaatgatgtcctactaaatgatgggaacagatagcatggtcagagaaaacctgtttggcttgggttctc

SEQ ID NO: 123036 - DNA, 557 bp, Homo sapiens
  Payload ID: 4160
  Gene Symbol: CLEC19A
  Gene Name: C-type lectin domain family 19, member A
  ENST ID: ENST00000493231
  CDS Start-End: 114-374
ccagctcctgccaggctccatctgaccctaggagagcaatcctggacccaagctccagccaaaaagcctctctcctccactcaggctgggaggttgctttctaggagctcaggatgcaaaggtggacactgtgggctgcagccttcctgaccctccactctgcacaggcctttccacaaacagacatcagtatcagtccagccctgccagagctgcccctgccttccctgtgccccctgttctggatggagttcaaaggccactgctatcgattcttccctctcaataagacctgggctgaggccgacctctactgttctgagttctctgtgggcaggaagtccgccaagctggcctccatccacagcctttgaactggaacatcagcctttttcctgcctttggactcaaactgaaacatcagttctttctgggactcaagcctgccagccttcagactggaactacaccagcagctctcctggatctcaggccttcatattcaggcaggaaatataccatcagctctcctgggtctccagcttgcccatccaccc

SEQ ID NO: 123037 - DNA, 732 bp, Homo sapiens
  Payload ID: 4161
  Gene Symbol: CLEC2A
  Gene Name: C-type lectin domain family 2, member A
  Uniprot ID: Q6UVW9
  ENST ID: ENST00000339766
  CDS Start-End: 19-501
atcggttagcgccttgccatgattaatccagagctgcgggatggcagagctgatggcttcatacatcggatagttcccaagttgatacaaaactggaagattggccttatgtgcttcctgagtattattattactacagtttgcattattatgatagccacatggtccaagcatgctaaacctgtggcatgttcaggggactggcttggagtgagagataagtgtttctatttttctgatgataccagaaattggacagccagtaaaatattttgtagtttgcagaaagcagaacttgctcagattgatacacaagaagacatggaatttttgaagaggtacgcaggaactgatatgcactggattggactaagcaggaaacaaggagattcttggaaatggacaaatggcaccacattcaatggttggccatcaaactccaaatggtcttgcaactggagcctccgacaatggcttcttctgctgggaccccttagataggcctctgagggagctctgactgccgtttccccaaaacaatgtcccctgtcagcaggaagcagttaaatctgtcttcatccttatccttaatataacggcagttagatgtacttctttagagggagtaaatttatcaattcagagcaattcatcctcctctttccatctttgattcacagttaataggctataaattttgataatgtagaataaactacagaaaacttcttg

SEQ ID NO: 123038 - DNA, 916 bp, Homo sapiens
  Payload ID: 4161
  Gene Symbol: CLEC2A
  Gene Name: C-type lectin domain family 2, member A
  Uniprot ID: Q6UVW9
  ENST ID: ENST00000455827
  CDS Start-End: 53-577
tgaaaagctttctagtcctctcctactgatctccatcggttagcgccttgccatgattaatccagagctgcgggatggcagagctgatggcttcatacatcggatagttcccaagttgatacaaaactggaagattggccttatgtgcttcctgagtattattattactacagtttgcattattatgatagccacatggtccaagcatgctaaacctgtggcatgttcaggggactggcttggagtgagagataagtgtttctatttttctgatgataccagaaattggacagccagtaaaatattttgtagtttgcagaaagcagaacttgctcagattgatacacaagaagacatggaatttttgaagaggtacgcaggaactgatatgcactggattggactaagcaggaaacaaggagattcttggaaatggacaaatggcaccacattcaatggttggtttgaaattatagggaacggatcctttgctttcttgagtgctgatggagtccatagttccagaggatttattgatatcaagtggatttgcagcaaacctaaatattttttatagagcagaaaaaacttgaaaatgattatcacacttcaagattgaaagaagagctaattatgcaaaagtggctttctcacttattctgttacagaatacggaacctctggtgagggcccattttctagtttatagatggaaacttcttgctgtgccctgccatggttaaagagacaaggccgttctctggagccttttataagggcacaatcacatttactatggctccatcctcatgaactaatcacctcctgatggatggctccatcccctaataccatcacactggtgattagctttcaatttatgagttttgggaggacccaaatactcagaacatag

SEQ ID NO: 123039 - DNA, 1700 bp, Homo sapiens
  Payload ID: 4162
  Gene Symbol: CLEC2B
  Gene Name: C-type lectin domain family 2, member B
  Uniprot ID: Q92478
  ENST ID: ENST00000228438
  CDS Start-End: 935-1384
ttttcctcttcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattggcaaaaaatggttacaggtattctgctgagtttttttctttctttctttctctctctctctttctttctttctttctttctttctttttttaactgtaaaccagaaaacaattgtggggatcaaggacagacatagcacttagacaggactttcatgaccc

SEQ ID NO: 123040 - DNA, 745 bp, Homo sapiens
  Payload ID: 4162
  Gene Symbol: CLEC2B
  Gene Name: C-type lectin domain family 2, member B
  ENST ID: ENST00000538152
  CDS Start-End: 336-578
ggaagtggacaaatagtgtaataaatatgtggtaattggaaatgctgtgcgagagctcaatttcaaacttgtctttctaggagcttacagtttgaaaattgtgaaggaatagatattcaaattgaacatttatcaatttggaatcatatctaaagaaaatgtatctaacatatttgtttcacaaaaaaaactgaaggtcagaggaaaaataaagtactttttcaaaactccatagctattttctagtgaggccaggagttgaacaattgttgccttgcacttcacaacctacgaaacaagaggtacacagtaggttgtcataaaaattggcatgtatgattttgaaattaattttgtctctaaagaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattggcaaaaaatggt

SEQ ID NO: 123041 - DNA, 465 bp, Homo sapiens
  Payload ID: 4163
  Gene Symbol: CLEC2D
  Gene Name: C-type lectin domain family 2, member D
  Uniprot ID: Q9UHP7
  ENST ID: ENST00000261339
  CDS Start-End: 1-465
atgcatgacagtaacaatgtggagaaagacattacaccatctgaattgcctgcaaacccagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctag

SEQ ID NO: 123042 - DNA, 935 bp, Homo sapiens
  Payload ID: 4163
  Gene Symbol: CLEC2D
  Gene Name: C-type lectin domain family 2, member D
  Uniprot ID: Q9UHP7
  ENST ID: ENST00000261340
  CDS Start-End: 23-607
actcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 123043 - DNA, 5279 bp, Homo sapiens
  Payload ID: 4163
  Gene Symbol: CLEC2D
  Gene Name: C-type lectin domain family 2, member D
  Uniprot ID: Q9UHP7
  ENST ID: ENST00000290855
  CDS Start-End: 23-598
actcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaaggtatggggaaaactgcccccataaagcaattgtctccacctggccctgccctttgcatgtggagattattacaattcaaggtgaaatttgggtggagacacaaccaaaccatatcagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatatataaaaaatagaatattattcagccttgtaaaaagaaatcctgttatgttgggaacaagccccccaaaatctggccataaactcaccccaaaactggccataaacaaaatctctgcagcactgtgacatgttagtgatggccataacacccacgctggaaggttgtgggtttatgggaatgagggcaaggaacacctggcctgcccagggtggaaaaccacttaaaggcgttcttaagctacaaacaatagcatgagcgatctgtgccttaaggacatgttcctgctgcagttaactagcccaatctattcctttaattcggcccatcccttcatttcccataagggatacttttagttaatttaatatctatagaaacaatgctaatgactggcttgctgttaataaatacatgggtaaatctctgttctgggctctcagctctgaaggctgtgagacccctgatttcccacttcacacctctatatttctgtgtgtgtgtctttagttcctctggcgctgctgggttaggatctacccgactgagctggtctcagcactgttatttgaaacaatgtaaataaacctatagggtttattatatatactaagtgaaataagccagacacagaaaaaaaatgttgcatgatctcacttatagtgaaacttaaaaaaaaaacccaaatacatagaaatagagtagaatggtggttaccagagatgaggaaaatacagagacacaggtcaaaagatacagagttgcagttacaaagggtgagtatgtctagatatctaacatacagtatgaggactataatagtattgcactgtgtactgaaaacttgatgacagattttagatattcttaccacacagacaaaaagaaatgtaagtatgtgagatgaagcttatgttaattagattaagtgtatgtacataaaaacatcacattatacacatcaaatatatacaataaaaaagcacattgggagatacatgataaatttctatctgcagttgctatttgcatttttaaaggatatttttattttttaaatttttagctgacaactgtataattatggaatacaatgtgatgttctgatatatgtgtacactatggaatgattaaatcaaactaacatttcatcatctcacatacttatcattttctgtggtgagaacatttgaaatttattctcttgacaattttgaaagatccaatacactattattaactatagtcactatgctgtgcaatagatctcaaaagcttattcctcttaactgaaacctactaccctgtgacatgtggggaacatctctctattccccagccccagtccctaaatgttgaatacacaatggggaaaaaatagtcttcaatgaatggtggtgggaaaattgtatatccacatgcagaagaataaaattggacccttacctcctaccatatataaaaaccaactgaaaatcgattaaagacttaaactgtaaaactactaaaagaaaatatagggagaaagcttcacaacgttggtctgggcaataatttttggatttgacctcaaaagtagatgcaaccacagtgaaaataaacaaatgaaattgcataaaataaaaaatgtttctgcacagcaaaggaaataattaatggagtaaagagacaacttacagattgggagaatatatttccaaactattgttggggctcagaaacggataccctaacatatagtgatttgacaggtggaactaaagaagactcgaggtctctctgacctcctcctcaacctctgtttcttaatcctctgttttcccagagcacaggaggaagttctctgaagttcctttatctgctttaagttcagactcaccaaataagaaaacagttaattctggtgccttccatgggttttcattaactgaagtcatattgtaggaaaaagaatgaagtctcttaacccacctggatagatttttctcacaaaccattgtcttctctgcaagcccagtagactttgtcccaggccatttatgtgatcttcaccccattaagttctccccaaattatttactcttcccccaaaatcacccacacttccccatctccctctcccctaaggacaagggtatatcaccatctataccccattgcttggtggggtgatcactctgattctctgcatgcatttttatagatttgtttgccatttatcctattaatctgcattctgtcaattgtggcaagttatcagcatattttttaacttttaattattcttaatggaaagacacttctgtatacactggaaatctcaggaaatttcttttttccttaagcttaattgaaatgtttacttttcagtaaaatttcaagcttgagtaatgttcatgcctgcttttcattgaaatagaatgaaaaggttgcacaatattattttcatgaaattacttctagtataattctgaataaacactttgaaaggcagtgaactgtaaata

SEQ ID NO: 123044 - DNA, 1552 bp, Homo sapiens
  Payload ID: 4163
  Gene Symbol: CLEC2D
  Gene Name: C-type lectin domain family 2, member D
  ENST ID: ENST00000325960
  CDS Start-End: 23-391
actcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagagaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggatcttcagattactaaaaagatttgagataatgctggaaaaattggattcacacaatttcactcaatgtttgtctgagagatgagacagttttgaaaagctactttattgtaatacattcatcaatattggaaatataactttatttaataaaaagagccccagactggacattggcaggtttgaaatgagttttttctcattagcttttgaccttggatgggatggtaagttttagaaatcagagaacatgtacatttatacattgttgtatctacactgccttgcacattgtgactgcttcataaatatctagaattaacttttatttcttattttacaatacggaagtagtaaattttctctacctaattcttaaaatggttttttgtttgtttgtatttttgagagacagggtcttactctgttacccaggctggagtgcagtagtaccatcgtggctcactgcagccttgacttccctggctcaagtgagcctcccatctcagcctcctgagtagctgggactacaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagtt

SEQ ID NO: 123045 - DNA, 1508 bp, Homo sapiens
  Payload ID: 4163
  Gene Symbol: CLEC2D
  Gene Name: C-type lectin domain family 2, member D
  ENST ID: ENST00000444971
  CDS Start-End: 19-387
atagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccct

SEQ ID NO: 123046 - DNA, 850 bp, Homo sapiens
  Payload ID: 4163
  Gene Symbol: CLEC2D
  Gene Name: C-type lectin domain family 2, member D
  ENST ID: ENST00000430909
  CDS Start-End: 1-522
tgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 123047 - DNA, 389 bp, Homo sapiens
  Payload ID: 4163
  Gene Symbol: CLEC2D
  Gene Name: C-type lectin domain family 2, member D
  ENST ID: ENST00000544322
  CDS Start-End: 1-321
gagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatgacaaaggtgccagtagtgccaggcactacacagagaggaagtggatttgttccaaatcagatatacatg

SEQ ID NO: 123048 - DNA, 571 bp, Homo sapiens
  Payload ID: 4163
  Gene Symbol: CLEC2D
  Gene Name: C-type lectin domain family 2, member D
  ENST ID: ENST00000536355
  CDS Start-End: 210-452
caaaaggggcccaccaaagctgccttgttccttctactatgtgaggacacatctagaagttaccatcaatgaaccagaaagtgggcccttaccaggcaccaaatctgccagcactctgatcttggacttccagcctcctgaactgttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagagaatttcctgttgagatataaaggcccatctgatcactggattgggctgagcagaga

SEQ ID NO: 123049 - DNA, 1855 bp, Homo sapiens
  Payload ID: 4163
  Gene Symbol: CLEC2D
  Gene Name: C-type lectin domain family 2, member D
  Uniprot ID: Q9UHP7
  ENST ID: ENST00000479877
  CDS Start-End: 8-472
aggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtaagttctaaaaatctggcagtaatatttgtatttgaatttactttgcattaaatctgaagtgttctctagttacatgctttaaaaaattctcattttaaggttagtcatgaaagaagatggtgccaacttgtatgttgcaaaggtttcacaagttcctcgaatgaatccaagacctgtcatggtgaggtagactgactgtgaacttggctccaggcttatctatgtcattttcaaacactttcattttaagcaaaccatacaatatctttaagtctgttccttacctccacaacaaaattaaattgcacttgtcctcctgatttcacagggttgatgtgaggaacagaggttttgatgtatcagggaaagattatgagtgacagcaattatacctattatttaaaataagacaatagttttaaaattttaaaatgggtaaagtttggcactagaaaatttaatctcaattgtatatttataggatcttcagattactaaaaagatttgagataatgctggaaaaattggattcacacaatttcactcaatgtttgtctgagagatgagacagttttgaaaagctactttattgtaatacattcatcaatattggaaatataactttatttaataaaaagagccccagactggacattggcaggtttgaaatgagttttttctcattagcttttgaccttggatgggatggtaagttttagaaatcagagaacatgtacatttatacattgttgtatctacactgccttgcacattgtgactgcttcataaatatctagaattaacttttatttcttattttacaatacggaagtagtaaattttctctacctaattcttaaaatggttttttgtttgtttgtatttttgagagacagggtcttactctgttacccaggctggagtgcagtagtaccatcgtggctcactgcagccttgacttccctggctcaagtgagcctcccatctcagcctcctgagtagctgggactacaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 123050 - DNA, 399 bp, Homo sapiens
  Payload ID: 4163
  Gene Symbol: CLEC2D
  Gene Name: C-type lectin domain family 2, member D
  Uniprot ID: Q9UHP7
  ENST ID: ENST00000543300
  CDS Start-End: 1-399
atgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatga

SEQ ID NO: 123051 - DNA, 541 bp, Homo sapiens
  Payload ID: 4163
  Gene Symbol: CLEC2D
  Gene Name: C-type lectin domain family 2, member D
  ENST ID: ENST00000492359
  CDS Start-End: 19-183
atagaaactggaggcaaaatgcatgacagtaacaatgtggagaaagacattacaccatctgaattgcctgcaaacccaggcacttctgtctcctgctgccatgtgaagaagaacacgtttgcttcctcttccaccattattgttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagaca

SEQ ID NO: 123052 - DNA, 761 bp, Homo sapiens
  Payload ID: 4163
  Gene Symbol: CLEC2D
  Gene Name: C-type lectin domain family 2, member D
  ENST ID: ENST00000460309
  CDS Start-End: 1-402
gcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacaagacagggtcttactctgttacccaggctggagtgcagtagtaccatcgtggctcactgcagccttgacttccctggctcaagtgagcctcccatctcagcctcctgagtagctgggactacaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaattt

SEQ ID NO: 123053 - DNA, 981 bp, Homo sapiens
  Payload ID: 4163
  Gene Symbol: CLEC2D
  Gene Name: C-type lectin domain family 2, member D
  ENST ID: ENST00000476198
  CDS Start-End: 269-511
agcttgcagggatccatgggagtagaacctactgattgagactgctgggctctcctccttggcttcagccccctttccatgggactggatggttctcgtgcctcactggagttccaggcaccactggagtatgtaaaaactcctgcagctcagtgcctgcctaaacagccaccaatgggagtggctgtcattggtttgcccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagagaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtgaggtagactgactgtgaacttggctccaggcttatctatgtcattttcaaacactttcattttaagcaaaccatacaatatctttaagtctgttccttacctccacaacaaaattaaattgcacttgtcctcctgatttcacagggttgatgtgaggaacagaggttttgatgtatcagggaaagattatgagtgacagcaattatacctattattta

SEQ ID NO: 123054 - DNA, 288 bp, Homo sapiens
  Payload ID: 4163
  Gene Symbol: CLEC2D
  Gene Name: C-type lectin domain family 2, member D
  Uniprot ID: Q9UHP7
  ENST ID: ENST00000545918
  CDS Start-End: 1-288
atgcatgacagtaacaatgtggagaaagacattacaccatctgaattgcctgcaaacccagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatga

SEQ ID NO: 123055 - DNA, 778 bp, Homo sapiens
  Payload ID: 4163
  Gene Symbol: CLEC2D
  Gene Name: C-type lectin domain family 2, member D
  ENST ID: ENST00000466035
  CDS Start-End: 1-423
gtggagaaagacattacaccatctgaattgcctgcaaacccagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtgaggtagactgactgtgaacttggctccaggcttatctatgtcattttcaaacactttcattttaagcaaaccatacaatatctttaagtctgttccttacctccacaacaaaattaaattgcacttgtcctcctgatttcacagggttgatgtgaggaacagaggttttgatgtatcagggaaagattatgagtgacagcaattatacctattatttaaaataagacaatagttttaaaattttaaaatgggtaaagtttggcactagaaaatttaatctcaattgtatatttataggatcttcagattactaaaaagatttgagataatgctggaaaaattggattcacacaatttcact

SEQ ID NO: 123056 - DNA, 1359 bp, Homo sapiens
  Payload ID: 4164
  Gene Symbol: CLEC2L
  Gene Name: C-type lectin domain family 2, member L
  Uniprot ID: P0C7M8
  ENST ID: ENST00000422142
  CDS Start-End: 73-717
gccgagtgcgcgtcgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcggcgatccgggtcgggctacgagggcagcaccagctggaaggcggccttggaggacaccaccacacgcctcctgctgggtgccatcgcggtccttctgttcgccatcttggtggtgatgagcatcttggcttccaagggctgcatcaagtgcgaagcgccctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgggtcaacggggacccgtttgatccggacacgttcaccatcgcaggtccaggggagtgtgtcttcgtggagcccaccaggctggtgtcgacggagtgtctgatgacccggccctgggtgtgcagcaagatggcctatacttgaggtgggtggggccagaggtggccccgcccctaggcctgtgggaggtgtctggtgtctgctcaagacctgcttccagcggagccgcctgccctctgcaaggcgaagcggtgggtgcgtggcctccgccccaggcccctctcccaggccctggcgctctgagtccctggttcctggcctcctttgtctgcaggcaggtcgtgtggctcagcagttaaatcccatatgctaggtagtgtaggcatctgcccacctacacacacacacatgcataggtacacgcacgcacagacgctgtcccttctgaagctcagtgtccatcctgagccaccccacagatctctctccggccccctagaagccctctcctcactgcagccctggtgctctggggaaggaggggcattgacaggtggtttgactgttcacccagcagccccgcttccccactggtttctctcctggctgccggcggaggtaggctgggaaagcttccccctcacctaggccgggccagccccgccccgggccccagaggtcccctgcatcccccttctttgccttgcctgggttctcaggcagggcccctgctgtgtccgtggtgctgttgtattggtcactaacggaataaagagttaatatctc

SEQ ID NO: 123057 - DNA, 324 bp, Homo sapiens
  Payload ID: 4164
  Gene Symbol: CLEC2L
  Gene Name: C-type lectin domain family 2, member L
  ENST ID: ENST00000521281
  CDS Start-End: 1-324
acgagggcagcaccagctggaaggcggccttggaggcttccaagggctgcatcaagtgcgaagcgccctgcccggaggactggctgctctacggaaggaagtgctacttcttttccgaggaacccagagactggaacacaggcaggcagtactgccacacccacgaggcggtgctggctgtgattcagagccagaaggagctggaatttatgttcaagttcacgcggagggagccctggattggactacgcagagttggggacgaattccactgggtcaacggggacccgtttgatccggacacgttcaccatcgcaggtccag

SEQ ID NO: 123058 - DNA, 1971 bp, Homo sapiens
  Payload ID: 4165
  Gene Symbol: CLEC3A
  Gene Name: C-type lectin domain family 3, member A
  ENST ID: ENST00000299642
  CDS Start-End: 86-706
acttttataagccagccccaggcatcccagagcaagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaatagaaaa

SEQ ID NO: 123059 - DNA, 1204 bp, Homo sapiens
  Payload ID: 4165
  Gene Symbol: CLEC3A
  Gene Name: C-type lectin domain family 3, member A
  ENST ID: ENST00000567430
  CDS Start-End: 86-238
acttttataagccagccccaggcatcccagagcaagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagaggtatctgctgaatcctccaaggggaacagaataaggggaagatccctggagatcagattctcagatccagtatcccgtgtgctgacctgccatgacaaacactggcagggagcctgccatagaggaaaagagtaagaattggctgagttcacatatgggctccatcaataactagcggccaggtgagattaggtatcatcactgtgccatctttgggaagaatgagaaaatagccactgcaataattttctggagggctattttttcctatgggacactgatggaggaagaccacagcccattgactagaaaaaggcctggaatggagttcacgccctcagagctcgtgcaggagccatctatgaactacaagcacattgactccgtatcctcacatgagccctgggaggcagccactgttaatatcctcattttatggatgaggaaactgttgccctgttaaagcttaatcagctttattatttgcttcccatcactgctgtcacaacttgccacaaactcactgatgtcacacaacacaaagttattatcttatggtttgggaggtcagatgtccaaagttggtctccttgggctaaaatcaaggtgtcagtgaggttggttccttctgaaattctgaggggagaatttgtttccttgcctttttattttgtttttgtttttgagacagagtctcactctgtcacccaggctggggtgcagtggcgccatcttggctcactgtaacctccacctcctgggttcaagagattgtcatgcctcagcctcccaagtagctgggattacaggtgcatgccaccacacccagctaatttttatatttttagtatagacagggtttcaccatgttggccaggctcgactcaaactcctgatctcaggtgacccccaacctcagcctccaaagtgctgggattacaagcctgagccactgtgcctggccttccttgcctttt

SEQ ID NO: 123060 - DNA, 936 bp, Homo sapiens
  Payload ID: 4166
  Gene Symbol: CLEC3B
  Gene Name: C-type lectin domain family 3, member B
  Uniprot ID: P05452
  ENST ID: ENST00000296130
  CDS Start-End: 181-789
cttctgcaggcttgtgtgtttgttttatttttttggcacgcctgcagccaagttggggagggtttcctggacagaggtcctttggctgctgccttaagacgtgcagcctgggccgtggctgtcactgcgttcggacccagacccgctgcaggcagcagcagcccccgcccgcgcagcagcatggagctctggggggcctacctcctcctctgcctcttctccctcctgacccaggtcaccaccgagccaccaacccagaagcccaagaagattgtaaatgccaagaaagatgttgtgaacacaaagatgtttgaggagctcaagagccgtctggacaccctggcccaggaggtggccctgctgaaggagcagcaggccctgcagacggtctgcctgaaggggaccaaggtgcacatgaaatgctttctggccttcacccagacgaagaccttccacgaggccagcgaggactgcatctcgcgcgggggcaccctgggcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtagccggcggggcgggggccgtggggggcctggaggagggcaggggccgcgggaggccgggaggagggtggggaccttgcagcccccatcctctccgtgcgcttggagcctctttttgcaaataaagttggtgcagcttcgcggagagga

SEQ ID NO: 123061 - DNA, 752 bp, Homo sapiens
  Payload ID: 4166
  Gene Symbol: CLEC3B
  Gene Name: C-type lectin domain family 3, member B
  ENST ID: ENST00000428034
  CDS Start-End: 126-608
cggcttagcccagagcctggcctcctctgtaagagtggaaaacctgggttccttctgccctcatcttattagtagctgtgatgggcacacactcagccaagcactgagatgttgtgaacacaaagatgtttgaggagctcaagagccgtctggacaccctggcccaggaggtggccctgctgaaggagcagcaggccctgcagacggtctgcctgaaggggaccaaggtgcacatgaaatgctttctggccttcacccagacgaagaccttccacgaggccagcgaggactgcatctcgcgcgggggcaccctgggcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtagccggcggggcgggggccgtggggggcctggaggagggcaggggccgcgggaggccgggaggagggtggggaccttgcagcccccatcctctccgtgcgcttggagcctctttttgcaaataaagttggtgcagcttcgcggaga

SEQ ID NO: 123062 - DNA, 1281 bp, Homo sapiens
  Payload ID: 4167
  Gene Symbol: CLEC4A
  Gene Name: C-type lectin domain family 4, member A
  Uniprot ID: Q9UMR7
  ENST ID: ENST00000229332
  CDS Start-End: 248-961
ctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatctgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtctc

SEQ ID NO: 123063 - DNA, 615 bp, Homo sapiens
  Payload ID: 4167
  Gene Symbol: CLEC4A
  Gene Name: C-type lectin domain family 4, member A
  Uniprot ID: Q9UMR7
  ENST ID: ENST00000352620
  CDS Start-End: 1-615
atgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcaagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatga

SEQ ID NO: 123064 - DNA, 841 bp, Homo sapiens
  Payload ID: 4167
  Gene Symbol: CLEC4A
  Gene Name: C-type lectin domain family 4, member A
  Uniprot ID: Q9UMR7
  ENST ID: ENST00000345999
  CDS Start-End: 27-524
aagaaagcagaagctctcttcccattatgacttcggaaatcacttatgctgaagtgaggttcaaaaatgaattcaagtcctcaggcatcaacacagcctcttctgcagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgt

SEQ ID NO: 123065 - DNA, 597 bp, Homo sapiens
  Payload ID: 4167
  Gene Symbol: CLEC4A
  Gene Name: C-type lectin domain family 4, member A
  Uniprot ID: Q9UMR7
  ENST ID: ENST00000360500
  CDS Start-End: 1-597
atgacttcggaaatcacttatgctgaagtgaggttcaaaaatgaattcaagtcctcaggcatcaacacagcctcttctgcagttttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatga

SEQ ID NO: 123066 - DNA, 349 bp, Homo sapiens
  Payload ID: 4167
  Gene Symbol: CLEC4A
  Gene Name: C-type lectin domain family 4, member A
  ENST ID: ENST00000546339
  CDS Start-End: 1-255
ttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcagatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatca

SEQ ID NO: 123067 - DNA, 1126 bp, Homo sapiens
  Payload ID: 4168
  Gene Symbol: CLEC4C
  Gene Name: C-type lectin domain family 4, member C
  Uniprot ID: Q8WTT0
  ENST ID: ENST00000354629
  CDS Start-End: 397-945
ttgctttctgtgctgtgcaagctttgttctttcgctgtttgggtccacggttcttttatgagctgtgataccgcggaagtctgtagcttcactcctgaagctagcaagaccacaagctcgccgagagaaacgagtaactctagacgtgccatcttaaaagctgtaacaccgcgaggcagatcctgcctcccacagtcaccctgctcccaagtgcaacctctgtctgaccctgcatggtgtgcggtgccctcctgcctcaggcctaggcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattcacacattcatttattcatttattcatt

SEQ ID NO: 123068 - DNA, 970 bp, Homo sapiens
  Payload ID: 4168
  Gene Symbol: CLEC4C
  Gene Name: C-type lectin domain family 4, member C
  Uniprot ID: Q8WTT0
  ENST ID: ENST00000360345
  CDS Start-End: 175-816
actgcagagtctcctaagtcacatctcttcctttgcaagagtaggcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagagaaaggactctggtggttccagttgaaggtctggtccatggcagtcgtatccatcttgctcctcagtgtctgtttcactgtgagttctgtggtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattc

SEQ ID NO: 123069 - DNA, 577 bp, Homo sapiens
  Payload ID: 4168
  Gene Symbol: CLEC4C
  Gene Name: C-type lectin domain family 4, member C
  ENST ID: ENST00000537530
  CDS Start-End: 1-267
gattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacgtgagtatagaatgagattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccatt

SEQ ID NO: 123070 - DNA, 1314 bp, Homo sapiens
  Payload ID: 4168
  Gene Symbol: CLEC4C
  Gene Name: C-type lectin domain family 4, member C
  Uniprot ID: Q8WTT0
  ENST ID: ENST00000542353
  CDS Start-End: 492-1133
cagtgattctcgtgcctcagcctcctgagtagccgaaattacagacgtgtgccaccatgcttggctaattttttggatttttagtagagatggggtttcactatgttggccaggctagtcttgaactcctggcctgaagcaatccgcccacctcagcctcccaaagtgctgagattataggcacgagccactacacctggccacaaaattctttaaagaagccaatcccatcctccctcaagagccaaggggccacctcaccctcttgttacagcagatcctgcctcccacagtcaccctgctcccaagtgcaacctctgtctgaccctgcatggtgtgcggtgccctcctgcctcaggccgcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagagaaaggactctggtggttccagttgaaggtctggtccatggcagtcgtatccatcttgctcctcagtgtctgtttcactgtgagttctgtggtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattcacacattcatttattcatttattcatt

SEQ ID NO: 123071 - DNA, 414 bp, Homo sapiens
  Payload ID: 4168
  Gene Symbol: CLEC4C
  Gene Name: C-type lectin domain family 4, member C
  ENST ID: ENST00000543765
  CDS Start-End: 1-414
gaagaagagcctcaagaccgagagaaaggactctggtggttccagttgaaggtctggtccatggcagtcgtatccatcttgctcctcagtgtctgtttcactgtgagttctgtggattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgag

SEQ ID NO: 123072 - DNA, 860 bp, Homo sapiens
  Payload ID: 4168
  Gene Symbol: CLEC4C
  Gene Name: C-type lectin domain family 4, member C
  Uniprot ID: Q8WTT0
  ENST ID: ENST00000540085
  CDS Start-End: 158-706
gtcacatctcttcctttgcaagagtaggcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattc

SEQ ID NO: 123073 - DNA, 1936 bp, Homo sapiens
  Payload ID: 4169
  Gene Symbol: CLEC4D
  Gene Name: C-type lectin domain family 4, member D
  Uniprot ID: Q8WXI8
  ENST ID: ENST00000299665
  CDS Start-End: 194-841
ctttgaaaaagacttcttttgagctaactttcttatactggtacctttctaatctcactacaatatgtaacattggtgttcgatctcaagtatttctgaatatattcccctatccacagaaatatactctgggggaaaaaaaatagaacaaattcttgccgtcctgaccattgaacaagagactaattagacaatggggctagaaaaacctcaaagtaaactggaaggaggcatgcatccccagctgataccttcggttattgctgtagttttcatcttacttctcagtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttggacttagagatgagaatgccaaaggtcagtggcgttgggtggaccagacgccatttaacccacgcagagtattctggcataagaatgaacccgacaactctcagggagaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcatttttccccttctcagactcttagctcttaaaattcaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatagaaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcattacttagctaacgactggataaaatttcttaattgtttgaagtaacattgtattcgtgtttgcattattaatttgaatagaaaataatcacattttcaacccatttatacaaattgttaatgtttctttagagctgtataactatagtttgaactagcaaggaagttattgttttgacaaccagaaattatgcttttctggtgcatgaaacattaattgcaaagggcagtcacatccaactttaataaaatatggtggtctttcttaaaa

SEQ ID NO: 123074 - DNA, 583 bp, Homo sapiens
  Payload ID: 4169
  Gene Symbol: CLEC4D
  Gene Name: C-type lectin domain family 4, member D
  ENST ID: ENST00000382064
  CDS Start-End: 152-583
gcctggcaaggtttagcggaggcctgcagtctgtctgctcctcagcaccatgaattcgactccatgcagctctccataaatatactctgggggaaaaaaaatagaacaaattcttgccgtcctgaccattgaacaagagactaattagacaatggggctagaaaaacctcaaagtaaactggaaggaggcatgcatccccagctgataccttcggttattgctgtagttttcatcttacttctcagtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttgga

SEQ ID NO: 123075 - DNA, 2159 bp, Homo sapiens
  Payload ID: 4170
  Gene Symbol: CLEC4E
  Gene Name: C-type lectin domain family 4, member E
  Uniprot ID: Q9ULY5
  ENST ID: ENST00000299663
  CDS Start-End: 167-826
aatattctacatctatcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatgttactggctgaagtgcattttctctctacgttagtctcaggtcctcttcccagaatttacaaagcaattcactaccttttgctacatttgcctcattttttagtgttcgtatgaaagtacagggacacggagccaagacagagtctagcaaagaaggggattttggaaggtgccttccaaaaatctcctgaatccgggctctgtagcaggtcctcttctttctagcttctgacaagtctgtcttctcttcttggtttcataccgttcttatctcctgcccaagcatatatcgtctctttactcccctgtataatgagtaagaagcttcttcaagtcatgaaacttattcctgctcagaataccggtgtggcctttctggctacaggcctccactgcaccttcttagggaagggcatgccagccatcagctccaaacaggctgtaaccaagtccacccatccctggggcttcctttgctctgccttattttcaattgactgaatggatctcaccagattttgtatctattgctcagctaggacccgagtccaatagtcaatttattctaagcgaacattcatctccacactttcctgtctcaagcccatccattatttcttaacttttattttagctttcgggggtacatgttaaaggctttttatataggtaaactcatgtcgtggaggtttgttgtacagattatttcatcacccaggtattaagcccagtgcctaatattgtttttttcggctcctctccctcctcctaccttccgccctcaagtagactccagtgtctgttattcccttctttgtgtttatgaattctcatcatttagctcccacttataagtgaggacatgcagtatttggttttctgttcccatgtttgctaaggataatggtctccagttctaccgatgttcccacaaaagacataatcttcttttttaaggctgcttagtattccatggtatctatgtatcacattttctctatccaatctattgttgactcacatttagattgattccatgtttttgctattgtgaatagtgctgcaatgaacattcgtgtgcatgtgtctttatggtagaaagatttatatttctctgagtatgtatccagtaatagcccattcatttattgcataaaattctaccaatac

SEQ ID NO: 123076 - DNA, 701 bp, Homo sapiens
  Payload ID: 4170
  Gene Symbol: CLEC4E
  Gene Name: C-type lectin domain family 4, member E
  ENST ID: ENST00000446457
  CDS Start-End: 81-359
aacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggtataatagtcccaaaggtgaacatcaaaatttacaaagcaacattttctggcttctagattgactttgggacagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgtta

SEQ ID NO: 123077 - DNA, 566 bp, Homo sapiens
  Payload ID: 4170
  Gene Symbol: CLEC4E
  Gene Name: C-type lectin domain family 4, member E
  ENST ID: ENST00000450725
  CDS Start-End: 109-387
attcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggtataatagtcccaaaggtgaacatcaaaatttacaaagcaacattttctggcttctagattgactttgggacaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggact

SEQ ID NO: 123078 - DNA, 730 bp, Homo sapiens
  Payload ID: 4170
  Gene Symbol: CLEC4E
  Gene Name: C-type lectin domain family 4, member E
  ENST ID: ENST00000545274
  CDS Start-End: 77-601
ctcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggtataatagtcccaaaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaa

SEQ ID NO: 123079 - DNA, 420 bp, Homo sapiens
  Payload ID: 4170
  Gene Symbol: CLEC4E
  Gene Name: C-type lectin domain family 4, member E
  ENST ID: ENST00000537698
  CDS Start-End: 1-284
agaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacc

SEQ ID NO: 123080 - DNA, 2475 bp, Homo sapiens
  Payload ID: 4171
  Gene Symbol: CLEC4F
  Gene Name: C-type lectin domain family 4, member F
  Uniprot ID: Q8N1N0
  ENST ID: ENST00000272367
  CDS Start-End: 78-1847
cactgccattggtccacgggacggcccttccaggagccagtggctgggagcagtgctggaggatcaaggaagcagagatggacggtgaggcagtccgcttctgcacagataaccagtgtgtctccctgcacccccaagaggtggactctgtggcaatggctcctgcagcccccaagataccgaggctcgttcaggctaccccggcatttatggctgtgaccttggtcttctctcttgtgactctctttgtagtggttcaacagcagacaagacctgttccgaagcctgtgcaagccgtaattctgggagacaacattactgggcatttaccttttgaacccaacaatcatcaccactttggcagggaggcagaaatgcgagagcttatccagacatttaaaggccacatggagaattccagtgcctgggtagtagaaatccagatgttgaagtgcagagtggacaatgtcaattcgcagctccaggtgctcggtgatcatctgggaaacaccaatgctgacatccagatggtaaaaggagttctaaaggatgccactacattgagtttgcagacacagatgttaaggagttccctggagggaaccaatgctgagatccagaggctcaaggaagaccttgaaaaggcagatgctttaactttccagacgctgaatttcttaaaaagcagtttagaaaacaccagcattgagctccacgtgctaagcagaggcttagaaaatgcaaactctgaaattcagatgttgaatgccagtttggaaacggcaaatacccaggctcagttagccaatagcagtttaaagaacgctaatgctgagatctatgttttgagaggccatctagatagtgtcaatgacttgaggacccagaaccaggttttaagaaatagtttggaaggagccaatgctgagatccagggactaaaggaaaatttgcagaacacaaatgctttaaactcccagacccaggcctttataaaaagcagttttgacaacactagtgctgagatccagttcttaagaggtcatttggaaagagctggtgatgaaattcacgtgttaaaaagggatttgaaaatggtcacagcccagacccaaaaagcaaatggccgtctggaccagacagatactcagattcaggtattcaagtcagagatggaaaatgtgaataccttaaatgcccagattcaggtcttaaatggtcatatgaaaaatgccagcagagagatacagaccctaaaacaaggaatgaagaatgcttcagccttaacttcccagacccagatgttagacagcaatctgcagaaggccagtgccgagatccagaggttaagaggggatctagagaacaccaaagctctaaccatggaaatccagcaggagcagagtcgcctgaagaccctccatgtggtcattacttcacaggaacagctacaaagaacccaaagtcagcttctccagatggtcctgcaaggctggaagttcaatggtggaagcttatattatttttctagtgtcaagaagtcttggcatgaggctgagcagttctgcgtgtcccagggagcccatctggcatctgtggcctccaaggaggagcaggcatttctggtagagttcacaagtaaagtgtactactggatcggtctcactgacaggggcacagagggctcctggcgctggacagatgggacaccattcaacgccgcccagaacaaagcgcctggttccaagggatcctgcccactcagaaagtatattattgtgaattctgggatgggagcttgcagcttcatagacacccctccctgtccctggatcctcagtaactaagagcaacctgagcacagacaccctcagggtactccttctcccagccctgtcctcatcctagggccactaggggatgaaggacccatctcaagtcagctccctagactcatcccatgtcagctccctaggagccacagcaccaggaagggatgctgccttcatctaacagtataaagccctgttgtcttcgggttttgggaaaagaatcagtctgacaactggcggcacaagaatgggcagactgaagactgtgtccaaattcagcagaagtggaatgacatgacctgtgacaccccctatcagtgggtgtgcaagaagcccatgggccagggtgtggcctgagggcaggccagagctgaggggctgctcctgcttgccaatactgaccctcctcctcgatgccttcggagcctctgagctctgcttgttctctgggaccttccgttggccttgtggacttcctgccttgttctttgattcagccctttcaaacatgcttacctcgagtgacccagtgacatcagtggcttctcaagggaagagccttgctgtgcccctgtagcctcagcacccagcacaggcctgtcagacagcaggtcctcaataaatactcgctggatcaacaaaa

SEQ ID NO: 123081 - DNA, 2012 bp, Homo sapiens
  Payload ID: 4171
  Gene Symbol: CLEC4F
  Gene Name: C-type lectin domain family 4, member F
  Uniprot ID: Q8N1N0
  ENST ID: ENST00000426626
  CDS Start-End: 25-1728
tgctggaggatcaaggaagcagagatggacggtgaggcagtccgcttctgcacagataaccagtgtgtctccctgcacccccaagaggtggactctgtggcaatggctcctgcagcccccaagataccgaggctcgttcaggctaccccggcatttatggctgtgaccttggtcttctctcttgtgactctctttgtagtggttcaacagcagacaagacctgttccgaagcctgtgcaagccgtaattctgggagacaacattactgggcatttaccttttgaacccaacaatcatcaccactttggcagggaggcagaaatgcgagagcttatccagacatttaaaggccacatggagaattccagtgcctgggtagtagaaatccagatgttgaagtgcagagtggacaatgtcaattcgcagctccaggtgctcggtgatcatctgggaaacaccaatgctgacatccagatggtaaaaggagttctaaaggatgccactacattgagtttgcagacacagatgttaaggagttccctggagggaaccaatgctgagatccagaggctcaaggaagaccttgaaaaggcagatgctttaactttccagacgctgaatttcttaaaaagcagtttagaaaacaccagcattgagctccacgtgctaagcagaggcttagaaaatgcaaactctgaaattcagatgttgaatgccagtttggaaacggcaaatacccaggctcagttagccaatagcagtttaaagaacgctaatgctgagatctatgttttgagaggccatctagatagtgtcaatgacttgaggacccagaaccaggttttaagaaatagtttggaaggagccaatgctgagatccagggactaaaggaaaatttgcagaacacaaatgctttaaactcccagacccaggcctttataaaaagcagttttgacaacactagtgctgagatccagttcttaagaggtcatttggaaagagctggtgatgaaattcacgtgttaaaaagggatttgaaaatggtcacagcccagacccaaaaagcaaatggccgtctggaccagacagatactcagattcaggtattcaagtcagagatggaaaatgtgaataccttaaatgcccagattcaggtcttaaatggtcatatgaaaaatgccagcagagagatacagaccctaaaacaaggaatgaagaatgcttcagccttaacttcccagacccagatgttagacagcaatctgcagaaggccagtgccgagatccagaggttaagaggggatctagagaacaccaaagctctaaccatggaaatccagcaggagcagagtcgcctgaagaccctccatgtggtcattacttcacaggaacagctacaaagaacccaaagtcagcttctccagatggtcctgcaaggctggaagttcaatggtggaagcttatattatttttctagtgtcaagaagtcttggcatgaggctgagcagttctgcgtgtcccagggagcccatctggcatctgtggcctccaaggaggagcaggcatttctggtagagttcacaagtaaagtgtactactggatcggtctcactgacaggggcacagagggctcctggcgctggacagatgggacaccattcaacgccgcccagaacaaagcgagccacagcaccaggaagggatgctgccttcatctaacagtataaagccctgttgtcttcgggttttgggaaaagaatcagtctgacaactggcggcacaagaatgggcagactgaagactgtgtccaaattcagcagaagtggaatgacatgacctgtgacaccccctatcagtgggtgtgcaagaagcccatgggccagggtgtggcctgagggcaggccagagctgaggggctgctcctgcttgccaatactgaccctcctcctcgatgccttcggagcctctgagctctgcttgttctctgggaccttccgttggccttgtggac

SEQ ID NO: 123082 - DNA, 1360 bp, Homo sapiens
  Payload ID: 4172
  Gene Symbol: CLEC4G
  Gene Name: C-type lectin domain family 4, member G
  Uniprot ID: Q6UXB4
  ENST ID: ENST00000328853
  CDS Start-End: 70-951
agtgcgtaggtccagtgagaacaggcgtgaaatttatatctctgcccaggactgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacaactgctgaccccgcccagtgccctggagccgcgcccattgcagcatgtcgtatcctgggggctgctcacctccctggctcctggagctgattgccaaagagttttttcttcctcatccaccgctgctgagtctcagaaacacttggcccaacatagccctgtccagcccagtgcctgggctctgggacctccatgccgacctcatcctaactccactcacgcagacccaacctaacctccactagctccaaaatccctgctcctgcgtccccgtgatatgcctccacttctctccctaaccaaggttaggtgactgaggactggagctgtttggttttctcgcattttccaccaaactggaagctgtttttgcagcctgaggaagcatcaataaatatttgagaaatgaatccagga

SEQ ID NO: 123083 - DNA, 509 bp, Homo sapiens
  Payload ID: 4172
  Gene Symbol: CLEC4G
  Gene Name: C-type lectin domain family 4, member G
  ENST ID: ENST00000599020
  CDS Start-End: 62-509
ggctgaagcaatcctccagcctcagcctcctgagtagctgggactaccgatacacatcaccatgcccagaaatgagggtcttgttatattgcccaggctggtctggtctggaactcctgggctcagtgatccttccatgtcggcctcccaaagtgctgggattacaggactgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcgg

SEQ ID NO: 123084 - DNA, 1278 bp, Homo sapiens
  Payload ID: 4172
  Gene Symbol: CLEC4G
  Gene Name: C-type lectin domain family 4, member G
  ENST ID: ENST00000620128
  CDS Start-End: 339-1097
ccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacctgctgaccccgcccagtgccctggagccgcgcccattgcagcatgtcgtatcctgggggctgctcacctccctggctcctggagctgattgccaaagagttttttcttcctcatccaccgctgctgagtctcagaaacacttggcccaacatagccctgtccagcccagtgcctgggctctgggacctccatgccgacctcatcctaactccactcacgcagacccaacctaacctccactagctccaaaatccctgctcctgcgtccccgtgatatgcctccacttctctccctaaccaaggttaggtgactgaggactggagctgtttggttttctcgcattttccaccaaactggaagctgtttttgcagcctgaggaagcatcaataaatatttgagaaatgaatccagg

SEQ ID NO: 123085 - DNA, 1865 bp, Homo sapiens
  Payload ID: 4173
  Gene Symbol: CLEC4M
  Gene Name: C-type lectin domain family 4, member M
  Uniprot ID: Q9H2X3
  ENST ID: ENST00000248228
  CDS Start-End: 119-1249
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 123086 - DNA, 1935 bp, Homo sapiens
  Payload ID: 4173
  Gene Symbol: CLEC4M
  Gene Name: C-type lectin domain family 4, member M
  Uniprot ID: Q9H2X3
  ENST ID: ENST00000327325
  CDS Start-End: 119-1318
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgca

SEQ ID NO: 123087 - DNA, 1781 bp, Homo sapiens
  Payload ID: 4173
  Gene Symbol: CLEC4M
  Gene Name: C-type lectin domain family 4, member M
  ENST ID: ENST00000334806
  CDS Start-End: 119-1165
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 123088 - DNA, 1733 bp, Homo sapiens
  Payload ID: 4173
  Gene Symbol: CLEC4M
  Gene Name: C-type lectin domain family 4, member M
  Uniprot ID: Q9H2X3
  ENST ID: ENST00000359059
  CDS Start-End: 119-1117
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 123089 - DNA, 1898 bp, Homo sapiens
  Payload ID: 4173
  Gene Symbol: CLEC4M
  Gene Name: C-type lectin domain family 4, member M
  ENST ID: ENST00000394122
  CDS Start-End: 119-1282
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccaactttcaattccagcagatacatggccacaagagctctacagggtgtcttggccatggcgccctggtgctgcaactcctctccttcatgctcttggctggggtcctgccaagattgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 123090 - DNA, 792 bp, Homo sapiens
  Payload ID: 4173
  Gene Symbol: CLEC4M
  Gene Name: C-type lectin domain family 4, member M
  Uniprot ID: Q9H2X3
  ENST ID: ENST00000595496
  CDS Start-End: 1-792
atgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatag

SEQ ID NO: 123091 - DNA, 999 bp, Homo sapiens
  Payload ID: 4173
  Gene Symbol: CLEC4M
  Gene Name: C-type lectin domain family 4, member M
  ENST ID: ENST00000596707
  CDS Start-End: 1-999
atgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatag

SEQ ID NO: 123092 - DNA, 870 bp, Homo sapiens
  Payload ID: 4173
  Gene Symbol: CLEC4M
  Gene Name: C-type lectin domain family 4, member M
  ENST ID: ENST00000595751
  CDS Start-End: 24-870
acatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgagg

SEQ ID NO: 123093 - DNA, 1669 bp, Homo sapiens
  Payload ID: 4173
  Gene Symbol: CLEC4M
  Gene Name: C-type lectin domain family 4, member M
  Uniprot ID: Q9H2X3
  ENST ID: ENST00000596363
  CDS Start-End: 51-941
aaaagctgtggtccccaggagtcctgaacatctggggacagcgggaaaacatgagtgactccaaggaaccaagggtgcagcagctgggcctcctggggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 123094 - DNA, 811 bp, Homo sapiens
  Payload ID: 4173
  Gene Symbol: CLEC4M
  Gene Name: C-type lectin domain family 4, member M
  Uniprot ID: Q9H2X3
  ENST ID: ENST00000597522
  CDS Start-End: 1-699
atgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatag

SEQ ID NO: 123095 - DNA, 1555 bp, Homo sapiens
  Payload ID: 4174
  Gene Symbol: CLEC5A
  Gene Name: C-type lectin domain family 5, member A
  ENST ID: ENST00000418498
  CDS Start-End: 222-383
ccctttgccaagaaccccactgaacaggaagaggtatttcttggggatgctaccaaggcagagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgacgaagagta

SEQ ID NO: 123096 - DNA, 501 bp, Homo sapiens
  Payload ID: 4174
  Gene Symbol: CLEC5A
  Gene Name: C-type lectin domain family 5, member A
  ENST ID: ENST00000439991
  CDS Start-End: 158-412
gaaggaagaacgttgcttgggcaaaaggagcatattctcaggagacggggcccctgcctgccacaccaagcattaggccaccaggaagacccccatctgcaagcaagcctagccttccagggagaaagagtcccacagatttttaacaaaagtaacgatggtttcaccaccaccaggagctatggaacagaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatct

SEQ ID NO: 123097 - DNA, 743 bp, Homo sapiens
  Payload ID: 4174
  Gene Symbol: CLEC5A
  Gene Name: C-type lectin domain family 5, member A
  ENST ID: ENST00000438351
  CDS Start-End: 148-615
ggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctgagacacattttaataaatgttttcttatgaaagagatcaaactttcataaggagaaagaagagta

SEQ ID NO: 123098 - DNA, 1420 bp, Homo sapiens
  Payload ID: 4174
  Gene Symbol: CLEC5A
  Gene Name: C-type lectin domain family 5, member A
  ENST ID: ENST00000551012
  CDS Start-End: 159-656
actgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggc

SEQ ID NO: 123099 - DNA, 3511 bp, Homo sapiens
  Payload ID: 4174
  Gene Symbol: CLEC5A
  Gene Name: C-type lectin domain family 5, member A
  Uniprot ID: Q9NY25
  ENST ID: ENST00000546910
  CDS Start-End: 198-764
caggaagaggtatttcttggggatgctaccaaggcagagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgacgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattggaagagttcctggatccttgcaagcttagataaatgtgatctttattagatagcagtggcatgctttaaaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtataccactggagttttctggttatctctcgtatagcaaaatctaactgatgcaatctccatctggccttcatccttctccctttattgtcctttcgtgtattgttcatccagcaaccaggatgatcttgttaaaacattaaacagattctgtcactctt

SEQ ID NO: 123100 - DNA, 1682 bp, Homo sapiens
  Payload ID: 4175
  Gene Symbol: CLEC6A
  Gene Name: C-type lectin domain family 6, member A
  Uniprot ID: Q6EIG7
  ENST ID: ENST00000382073
  CDS Start-End: 187-816
agttgtaattgtgacttcttcttttgaggtacacttaatgttggaagtctcttagtcctataagagtgtgtagcagtttgtccctgagctctagcttctttaaatgaagctgagtctctgggcaacatctttagggagagaggtacaaaaggttcctggaccttctcaacacagggagcctgcataatgatgcaagagcagcaacctcaaagtacagagaaaagaggctggttgtccctgagactctggtctgtggctgggatttccattgcactcctcagtgcttgcttcattgtgagctgtgtagtaacttaccattttacatatggtgaaactggcaaaaggctgtctgaactacactcatatcattcaagtctcacctgcttcagtgaagggacaaaggtgccagcctggggatgttgcccagcttcttggaagtcatttggttccagttgctacttcatttccagtgaagagaaggtttggtctaagagtgagcagaactgtgttgagatgggagcacatttggttgtgttcaacacagaagcagagcagaatttcattgtccagcagctgaatgagtcattttcttattttctggggctttcagacccacaaggtaataataattggcaatggattgataagacaccttatgagaaaaatgtcagattttggcacctaggtgagcccaatcattctgcagagcaatgtgcttcaatagtcttctggaaacctacaggatggggctggaatgatgttatctgtgaaactagaaggaattcaatatgtgagatgaataagatttacctatgagtagaagcttaattggaaagaagagaagaattactgacgtaattttttccctgacgtctttaaaattgaaccctatcatgaaatgataatttcttcctgaatttacacataatccttatgttatagaggttcacagaaatggaaagatacctgtttccctttaatcaatcttctcgtttcctcttttccattaatgatagaatgcacccttcctctctttgttccattctttcacttgttattcatttttttctttcttcacacttcattacacaaatatttattgtttcagagactgtactattttgtttgttagaagatttataaggcagtatcttttgaaaattatgactttccttcctcaatataccataaagaaatctttttggtcaagatggtagttggaactacaatcatctgaaggcctgacaagagttgaaagacatgttttctagatggctcactcacatggctggcaacttggtgttggctattaatgtaacctggaaataaattttattctgcagttagggatttggcattttatatatgttgattcaatcaagtttggcaagcagggtgttcgatactgctatatcctgtattcttggtttatttgttttatttctgagaaatatgtgttaagatctctcgctgattgggaatttgtctatttctcatttaaattttgtcaaatctttctttgcttgcaagcatttcttgttacccaaatctaatctattcctgaaaatatgatggttagcaaagtttgagataactagagcctgtaatccatcattttaaatggcaatgataatgacagtttatttttatgttatataaaaacctcaacaaattttccaaac

SEQ ID NO: 123101 - DNA, 2446 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000353231
  CDS Start-End: 160-765
atctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 123102 - DNA, 1154 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000298523
  CDS Start-End: 72-503
agacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataag

SEQ ID NO: 123103 - DNA, 1130 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000304084
  CDS Start-End: 156-899
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatc

SEQ ID NO: 123104 - DNA, 425 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000310002
  CDS Start-End: 108-341
ccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctggtttcaaagctgtggaattcaaaggataaattaatgaagaaaacaagcggagctgaagaagaaagtacaatatggtgctgtcttcctaatgaaataaattcactaaatggaca

SEQ ID NO: 123105 - DNA, 355 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000349926
  CDS Start-End: 1-138
atggaatatcatcctgatttagaaaatttggatgaagatggatatactcaattacacttcgactctcaaagcaataccaggatagctgttgtttcagagaaagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 123106 - DNA, 1000 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000396484
  CDS Start-End: 104-610
atgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgcca

SEQ ID NO: 123107 - DNA, 625 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000533022
  CDS Start-End: 1-570
atggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 123108 - DNA, 1592 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000529761
  CDS Start-End: 72-815
atttcctgctcttgaatatctggttgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 123109 - DNA, 915 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000531192
  CDS Start-End: 176-754
tttcctgctcttgaatatctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctcc

SEQ ID NO: 123110 - DNA, 573 bp, Homo sapiens
  Payload ID: 4176
  Gene Symbol: CLEC7A
  Gene Name: C-type lectin domain family 7, member A
  ENST ID: ENST00000525605
  CDS Start-End: 71-481
tttcctgctcttgaatatctggttgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtgagtatttggtggaggagattaacaacagacaatttagtaagcaattattatgtgccaggcactcttttaagggcttgacatgcataatctactttaatttgtatataatctggttttatctgtattgggttggtgctgttaatgcccatttcacttataaagggtgtgagagactgagaggttattttacctttccagggttataagctagttagtggtgggaccatgattagaaatttgggtgatctgtctaaaaaactcatactcttaactacattgctctcctacctcccttaca

SEQ ID NO: 123111 - DNA, 881 bp, Homo sapiens
  Payload ID: 4176
  Gene Symbol: CLEC7A
  Gene Name: C-type lectin domain family 7, member A
  Uniprot ID: Q9BXN2
  ENST ID: ENST00000465100
  CDS Start-End: 1-351
atggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtactgggcagtttctcaaggatctctcatttttaaataacagaagaaagctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 123112 - DNA, 1734 bp, Homo sapiens
  Payload ID: 4177
  Gene Symbol: CLEC9A
  Gene Name: C-type lectin domain family 9, member A
  Uniprot ID: Q6UXN8
  ENST ID: ENST00000355819
  CDS Start-End: 614-1339
cgtttgtacccggctgtggcaatctgtggtgaagttgaaatgcttttctgctagactggcaacatgttttgattcttctcaaataactcgcaagctcttgtgaagcacaacggcctaccttgtcctgaagaaaacatactctaaggcccacagatgattaaacccagccatttatgtgacaatagcatttttatttttcttatcaagatctgggtatttgatccacacaatggtaaagattcccatgttagccaagatctaaatgattcaaactgatgatactctctgcagaagaggtgactataaacgcagcccctgtgatgccaactggacatattatggagatagctgctatgggttcttcaaacacaacttgacatggaaagagagtgagcagtactgcactgacatgaaggctactctcctgaagactgacaaccagaacattctgtggatagaagtcaagggctccaatgtctcccaagacgaaagaatcccaagtctcatttggaggaatgctatcactaactaggattcctggagctaaaacattataggagttacttgttccagcctcctgtgtggactgctttcctatcaaagcaccttagacatgcacgaggaagaaatatacacctctcttcagtgggatagcccagcaccagacacttaccagaaatgtctgtcttccaacaaatgttcaggagcatgctgtcttgtgatggtgatttcatgtgttttctgcatgggattattaacagcatccattttcttgggcgtcaagttgttgcaggtgtccaccattgcgatgcagcagcaagaaaaactcatccaacaagagagggcactgctaaactttacagaatggaagagaagctgtgcccttcagatgaaatattgccaagccttcatgcaaaactcattaagttcagcccataacagcagtccttgtccaaacaattggattcagaacagagaaagttgttactatgtctctgaaatttggagcatttggcacaccagtcaagagaattgtttaaaggaaggttccacgctgctacaaatagagagcaaagaagaaatggattttatcactggcagcttgaggaagattaaaggaagctatgattactgggtggggttgtctcaggatggacacagcggacgctggctttggcaagatggctcctctccttctcctggcctgttgccagcagagagatcccagtcagctaaccaagtctgtggatacgtgaaaagcaattcccttctttcgtctaactgcagcacgtggaagtattttatctgtgagaagtatgcgttgagatcctctgtctgaaagaaattgtgttcaaagtgttctattacactgttatttggagcatgccattggaaaacccacccccaccccccctcaaaaaaacagaacagtaaaccaaaatgtgggccatgaaattagcaacctgggactcaataatacacttgggaatattcttccacaccgtccagatttcatttgatgttgttcacattgcaagagtaaaacttatttagagctacagaagacaaaaccctgaagagttaagaacaaacgcaaggaaataatttttattgtttaaagcccggaatgactgtaactttcacacaaggtacgcatctatgtttttgggggaggtgatgtagttacagctgactaatatttttaaaataaataaataaatttggcctttaaaa

SEQ ID NO: 123113 - DNA, 670 bp, Homo sapiens
  Payload ID: 4178
  Gene Symbol: CLECL1
  Gene Name: C-type lectin-like 1
  Uniprot ID: Q8IZS7
  ENST ID: ENST00000327839
  CDS Start-End: 36-539
ggcagaaaactaactgaaaaacgagaacctactgtatggttagtaatttcttccatgtcatacaagtattcgagaaatctgctaccttgattagtaagactgaacacattggttttgtcatttattcatggaggaagtccaccacccacttggggagcagaaggaaatttgccatctcaatttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagtgaattttttgtgctacaaacttggcaaaagtctgtgaaaagaagtttcaacttcatgtgttattaactatacaaatattagttgaatgaattgttgaattaca

SEQ ID NO: 123114 - DNA, 557 bp, Homo sapiens
  Payload ID: 4178
  Gene Symbol: CLECL1
  Gene Name: C-type lectin-like 1
  ENST ID: ENST00000542530
  CDS Start-End: 1-359
tttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatgaaatccaatcttttttgacatatgcatatagaagttcctagacttcagtgctgaggagacagaggctacaggcatccatatgtctgtctctggggtcttcttaggaagaggcctctgatgaagagaacaaagctcttgtttgatatcccagcttgagcaagaggaatgggacaagttcgtggcagccaccagccgccaggagatggctgaagtaga

SEQ ID NO: 123115 - DNA, 1069 bp, Homo sapiens
  Payload ID: 4178
  Gene Symbol: CLECL1
  Gene Name: C-type lectin-like 1
  ENST ID: ENST00000540988
  CDS Start-End: 1-108
caagacattactgctatgctgatcacctttttgctgtaccttcaaatggcatttcttcaatgtgtgtacatctctgatgtctctgtgtatccaaatttcttcttgtaaggacattatcagattggattagggcccaccgcaatggcctcactaaatccaatcttttttgacatatgcatatagaagttcctagacttcagtgctgaggagacagaggctacaggcatccatatgtctgtctctggggtcttcttaggaagaggcctctgatgaagagaacaaagctcttgtttgatatcccagcttgagcaagaggaatgggacaagttcgtggcagccaccagccgccaggagatggctgaagtagacaatcaatttccaggttattgggaaattcaagaccaatcaatagaattatctggagataaactctctgggacagtgttcatcaagttgcagtgccctgtttgagtccgagttagtgttagtcggagatacagtgaagtctaaggaggatgaggaagagtgattggtgatagcagataaaagaaaaatgaatcagtgggataaatggagatgaccaagtttggcgagaagacaatactatgagagaaggtgtccagagacagagtgagacacagatataggaacaggatcctgggccttcctgctccaggaaaagcatggaaaaggcaagttgtgagggcagaagacagtcccacaagaacatgaaattcagtcatgcaaagggctgggaaggcagaaacacagtggtgagagtgagccagaaaggagatgtggggagcaaggactcatggcagagaaggccctggtaaccaagataagaaagtcaactgtgaaggtgaactaagaacacatgatggatgagtggaaaccaggggccagaaagtctttgaaggcagaagatacaaggcaatttgtgggcaggagggaaaaaagtagtgaaaatgtgcaggccaatgtgagaggggcctgtgatggcagagaggaggccaatgatgtgagtaaaaggagcactgcaggaaccggacccagtgtgacgttatga

SEQ ID NO: 123116 - DNA, 611 bp, Homo sapiens
  Payload ID: 4178
  Gene Symbol: CLECL1
  Gene Name: C-type lectin-like 1
  ENST ID: ENST00000621400
  CDS Start-End: 36-611
ggcagaaaactaactgaaaaacgagaacctactgtatggttagtaatttcttccatgtcatacaagtattcgagaaatctgctaccttgattagtaagactgaacacattggttttgtcatttattcatggaggaagtccaccacccacttggggagcagaaggaaatttgccatctcaatttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatgctgatcacctttttgctgtaccttcaaatggcatttcttcaatgtgtgtacatctctgatgtctctgtgtatccaaatttcttcttgtaa

SEQ ID NO: 123117 - DNA, 54 bp, Homo sapiens
  Payload ID: 4179
  Gene Symbol:
  Gene Name: CU104787.1
  ENST ID: ENST00000623473
  CDS Start-End: 1-54
gctgcaggcagtgttcttctgtgtctgctcaccgagctgctccgagcccggctt

SEQ ID NO: 123118 - DNA, 12134 bp, Homo sapiens
  Payload ID: 4180
  Gene Symbol: CSMD1
  Gene Name: CUB and Sushi multiple domains 1
  ENST ID: ENST00000335551
  CDS Start-End: 1-8902
agaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaaggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaattccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaaataaattatttacacagggtttatacacactatccattgtatataagcattatttcatattatcaagctaaacattcccccatcagcttagttggagtgttagggaaaagtattcctagatatggcacagattttaaaaggaaatacagtattgaagagatttattttattattgcttcaattagctccatttacgtgttgaattcattgaagaggtccaatgagaaaaaaacagaagcctccttatttcacacgttttcctcctttagtaccatcctcatccaattactgtctctctgatactacttaatagcagggggtttgcagaaatttctgtttgccatgtaaaactgtgaatagtaatttattttagatagtcgatgaacttgtgggttttagctcacaatgcagccttcccttttgcagtgttttttttttgtttttttttttttttgtcttttactgtgccatcgatctttgatattgcattgaaagacaatataccacagtagcaccttgaactcagtgaaaattgttcaggatcaaaataccaagtgttcttttagagggaaggaaaaagtacacacactctcctctcacaatgatatattttatacattcatttgttatttgtttcatgctttatgattccagatggaaaggtaatttcagtgacttttcaagtttaaattccattataggtaaatgataagttatgatgcaaataaaatctataagatccccagggcaaataaaaatcaaaacatgaagtagaagatgtggccgtgaggtagtttatgtaacaaattcaaagtgaaaatcatgtttacttttacttatacttatttgataaaaatatttttgaaacgatagtacttattttattatttgatatttcagttcctattcaattgtggcagattttctctgtttcacattttagattggcgttggtaatagaaatgtcagaatgttcaaattggccttcacgttgtcggagtgaacacattgacacctagctttaagactgatttatctgttggtgtactgaaggtttccatgtaggacttcaaatgtggaaaaggaaaagcagtcaggaaaatggggcattctttggagagtcacgcgttttgattcggacatttccgtagagctcggctcccagtgttgtgttcctcggtcgaaagggtctctgctgtttggggactcactggcctctcctagggactcctttgtcttgtgaaccccacgctgttggattctgtatcattatgctgaattctctgcacagttttccctggccaacctgcccacatccttggagatttgctttgccagtgggaatccttacattgctgtttcacagtagacgggacgaggtcagcgggagtcgtgctcctaacacacacattgaacgaaacagaagatgattgaaagtgtgaggaggctcgtgtgcaagggagaacagggttactatacatattagtgtatatatatacatacatatatatatatatatattgtacatatctaagtttgagtcattcaaactaggtgcaaaatgctgacttcagagtctgaattaacatctctgttcccatatccctgacctgctccctggtcaacgatgctatgaaatcctgaaatgacaggacatacatacatacaagaaaccacatatcaaattagatatgattttcctttgtgtgcaaagtcaaactgtcctagggttgccagtttgaagcatgttatttaaatgaaaaaaaaaatcagtgaaattctcgtgtgagaattctgcctagtttcttcctaaggttgtgtgcagtgttgaacggcgtctccgcaaggtgttggaggatctcattttagggcagtcaggagctgtgcttgctgagttaggtctagaagactcttccctgaaggcaacgggaacacgcgtgagggacgcgaccacacactaacagaggacacgtgcttcagagctgtttaaaactgctgcttgttttacacacacatcttgccttttttcaggctagctgcaataatttttttcttctgtaaaatattttgtaaacaacaacaaaaagctattataaaaagggggtaaaaaaaagaacgctggcattatgatcaggaaaacccattgtcatcgccgaccctccctcccgtcccaccacacgctgctgtcacgacgtaggtgcgaaagacctttttgtacagagatatattttttatgaagaatttgtaaaattattaaatatgctgtaattttttgattaatgtaggtacattgttaaaaaataaatgtttttacaatacagaactgtaattttcccaataatgtaaaatgtaccatctctagctgattttcagttccaatcctattacacatgtattaatattaaagtggcctgttaaaatgaacagtatcttttttttgtcaaaaaaattataaagagggtgtaatatagcctgtgcaatgccaccaatctttaaagcaaatcagagttctaattaaatatttaattttagatttcta

SEQ ID NO: 123119 - DNA, 10938 bp, Homo sapiens
  Payload ID: 4180
  Gene Symbol: CSMD1
  Gene Name: CUB and Sushi multiple domains 1
  ENST ID: ENST00000400186
  CDS Start-End: 286-10452
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 123120 - DNA, 11740 bp, Homo sapiens
  Payload ID: 4180
  Gene Symbol: CSMD1
  Gene Name: CUB and Sushi multiple domains 1
  ENST ID: ENST00000520002
  CDS Start-End: 557-11254
gactgcgccgtgcccagcctcggtcccctctctgtgggtaaggatggttgagtccagcctccacggcagcggctccttgtgccactagcagcccttcttctgcgctctccgccttttctctctagactggatctctcctcccccccgcgcccccctccccgcatctcccactcgctggctctctctccagctgcctcctctccaggtctctcctggctgcgcgcgctcctctccccgcttctccccctcccgcagcctcgccgccttggtgccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 123121 - DNA, 13512 bp, Homo sapiens
  Payload ID: 4180
  Gene Symbol: CSMD1
  Gene Name: CUB and Sushi multiple domains 1
  ENST ID: ENST00000537824
  CDS Start-End: 1-10281
gttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctgactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaaataaattatttacacagggtttatacacactatccattgtatataagcattatttcatattatcaagctaaacattcccccatcagcttagttggagtgttagggaaaagtattcctagatatggcacagattttaaaaggaaatacagtattgaagagatttattttattattgcttcaattagctccatttacgtgttgaattcattgaagaggtccaatgagaaaaaaacagaagcctccttatttcacacgttttcctcctttagtaccatcctcatccaattactgtctctctgatactacttaatagcagggggtttgcagaaatttctgtttgccatgtaaaactgtgaatagtaatttattttagatagtcgatgaacttgtgggttttagctcacaatgcagccttcccttttgcagtgttttttttttgtttttttttttttttgtcttttactgtgccatcgatctttgatattgcattgaaagacaatataccacagtagcaccttgaactcagtgaaaattgttcaggatcaaaataccaagtgttcttttagagggaaggaaaaagtacacacactctcctctcacaatgatatattttatacattcatttgttatttgtttcatgctttatgattccagatggaaaggtaatttcagtgacttttcaagtttaaattccattataggtaaatgataagttatgatgcaaataaaatctataagatccccagggcaaataaaaatcaaaacatgaagtagaagatgtggccgtgaggtagtttatgtaacaaattcaaagtgaaaatcatgtttacttttacttatacttatttgataaaaatatttttgaaacgatagtacttattttattatttgatatttcagttcctattcaattgtggcagattttctctgtttcacattttagattggcgttggtaatagaaatgtcagaatgttcaaattggccttcacgttgtcggagtgaacacattgacacctagctttaagactgatttatctgttggtgtactgaaggtttccatgtaggacttcaaatgtggaaaaggaaaagcagtcaggaaaatggggcattctttggagagtcacgcgttttgattcggacatttccgtagagctcggctcccagtgttgtgttcctcggtcgaaagggtctctgctgtttggggactcactggcctctcctagggactcctttgtcttgtgaaccccacgctgttggattctgtatcattatgctgaattctctgcacagttttccctggccaacctgcccacatccttggagatttgctttgccagtgggaatccttacattgctgtttcacagtagacgggacgaggtcagcgggagtcgtgctcctaacacacacattgaacgaaacagaagatgattgaaagtgtgaggaggctcgtgtgcaagggagaacagggttactatacatattagtgtatatatatacatacatatatatatatatatattgtacatatctaagtttgagtcattcaaactaggtgcaaaatgctgacttcagagtctgaattaacatctctgttcccatatccctgacctgctccctggtcaacgatgctatgaaatcctgaaatgacaggacatacatacatacaagaaaccacatatcaaattagatatgattttcctttgtgtgcaaagtcaaactgtcctagggttgccagtttgaagcatgttatttaaatgaaaaaaaaaatcagtgaaattctcgtgtgagaattctgcctagtttcttcctaaggttgtgtgcagtgttgaacggcgtctccgcaaggtgttggaggatctcattttagggcagtcaggagctgtgcttgctgagttaggtctagaagactcttccctgaaggcaacgggaacacgcgtgagggacgcgaccacacactaacagaggacacgtgcttcagagctgtttaaaactgctgcttgttttacacacacatcttgccttttttcaggctagctgcaataatttttttcttctgtaaaatattttgtaaacaacaacaaaaagctattataaaaagggggtaaaaaaaagaacgctggcattatgatcaggaaaacccattgtcatcgccgaccctccctcccgtcccaccacacgctgctgtcacgacgtaggtgcgaaagacctttttgtacagagatatattttttatgaagaatttgtaaaattattaaatatgctgtaattttttgattaatgtaggtacattgttaaaaaataaatgtttttacaatacagaactgtaattttcccaataatgtaaaatgtaccatctctagctgattttcagttccaatcctattacacatgtattaatattaaagtggcctgttaaaatgaacagtatcttttttttgtcaaaaaaattataaagagggtgtaatatagcctgtgcaatgccaccaatctttaaagcaaatcagagttctaattaaatatttaattttagatttct

SEQ ID NO: 123122 - DNA, 11740 bp, Homo sapiens; identical to SEQ ID NO: 123120
  Payload ID: 4180
  Gene Symbol: CSMD1
  Gene Name: CUB and Sushi multiple domains 1
  ENST ID: ENST00000602557
  CDS Start-End: 557-11254

SEQ ID NO: 123123 - DNA, 10938 bp, Homo sapiens; identical to SEQ ID NO: 123119
  Payload ID: 4180
  Gene Symbol: CSMD1
  Gene Name: CUB and Sushi multiple domains 1
  ENST ID: ENST00000602723
  CDS Start-End: 286-10452

SEQ ID NO: 123124 - DNA, 11737 bp, Homo sapiens
  Payload ID: 4180
  Gene Symbol: CSMD1
  Gene Name: CUB and Sushi multiple domains 1
  ENST ID: ENST00000635120
  CDS Start-End: 557-11251
gactgcgccgtgcccagcctcggtcccctctctgtgggtaaggatggttgagtccagcctccacggcagcggctccttgtgccactagcagcccttcttctgcgctctccgccttttctctctagactggatctctcctcccccccgcgcccccctccccgcatctcccactcgctggctctctctccagctgcctcctctccaggtctctcctggctgcgcgcgctcctctccccgcttctccccctcccgcagcctcgccgccttggtgccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 123125 - DNA, 13108 bp, Homo sapiens
  Payload ID: 4181
  Gene Symbol: CSMD2
  Gene Name: CUB and Sushi multiple domains 2
  Uniprot ID: Q7Z408
  ENST ID: ENST00000241312
  CDS Start-End: 30-10493
tcctgggatggggtaggaggctattgtgaatgaggctcataagcatcgcccccggccctagatggcaagttcaaagccaccacccaagatcagctggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggatttgacttactcccaccagatttcttccttcctgagaggttttgatctctcggagttggaaagaaccaactcaactcctcccgtcgccgcttcctatgtctgggatcttgatcctggttgtgaagcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgctggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattg

SEQ ID NO: 123126 - DNA, 1544 bp, Homo sapiens
  Payload ID: 4181
  Gene Symbol: CSMD2
  Gene Name: CUB and Sushi multiple domains 2
  ENST ID: ENST00000338325
  CDS Start-End: 414-1091
caactgatgaaaggaggaagaagaaagggacttggaacaagcaagaaaatgagcctaatggtggcccatgtgatcaaatttgcataaggacagaagacaagaccgaaggagctgatgggtagagaggagatattgctgtcaacagagtggaggtctcagtggggaaagatgaactctactggaggttcagaaaacaactgtgaaagaaatacttgaggcatgtttcaacagactgcaaatataccatctaattcttggaaacaagtacaagataaattgattctgaagctgagggctttgggcagcaaaatctgactttccggaagaggtgtaagatggtgctggtggagctttgtaaggattctctgcagggctagagttctgagtccacaggtcctctttgcaaagcccgcatgtgtgatgcccaccttcgaggcccctcgggcatcatcacctcccccaatttccccattcagtatgacaacaatgcacactgtgtgtggatcatcacagcactcaacccctccaaggcgggaggagacccagggaacatacaatgcaacaaggagggtctaagtgtggaaactcaaagtctaagactgaggaatagaagttgtcttctgggaaacagcaaggacaatggatgctgtgtgcctaaccctgttcatggaactggcctacaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgtgtaagtgagcagggaggaggccacgccagggtcttcactgagaggcaggggcccgtttcctagctaatccaggggccccgtccctgggaaccttgcaggttgtaacaacagctgcactctggttggtttattctactcctcggaacgttgctggtggggtccttatttctggcaggaatgtcgactgtagcactgagaacaagtgctcctgacatttggggatgctcttcaacaccgtcttacccttcttggtgatccttaagagcaaggagacaccactgggacaaagcccaccaggctcagacccagacatttcctgctcaccgtcattgccacccctgacaccatctaatccagcagggtggaagggactgtcaagtttgtaaggctgtagacaccaccagcctccagtaactgtgggaaactggccttgccaggatataaacagtttcctaaaattg

SEQ ID NO: 123127 - DNA, 3212 bp, Homo sapiens
  Payload ID: 4181
  Gene Symbol: CSMD2
  Gene Name: CUB and Sushi multiple domains 2
  ENST ID: ENST00000373377
  CDS Start-End: 507-1787
caggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgatcactgcagatattttaaccagaaatcaggaaagctggattttactcccagctccaccttgggccagctgtgtaaaaccttgcacaggtcccttccccacttgagacttcagtttcttcacctgtagaattaccggcttggagtttgtgacctgtaagaattctgtgaggtagtaaggcaaatattctaacccccactttacaaatgaagaaatagggcaaaggaaggctcaagtacttgcccaaaaccatgtggatagaactggaaacagaacccagcctccgcagtatctgctgcagtatctgctacagtatctgctctggtgtgactatacagtgttattacatcatgcgtgcacttgcagaaacacactaagactgtgaaagaggtagtgaaagaaacaggaagcaacagagagaaacaaggatgtaaagaacctaagcagctgtgactgccattcccaggagctatcgtccagggtgagtgcaatgtgggaatgagactccgccctctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcacccttctgagcctcaatgttattatgcacaaaataggaatcatataagtacctaacctcctaaagttaaatgaaacaatgcttggaaatccttagctccaggcacagagtataaaaggtgatcaataaattatagttctaatagtcatcattgtcatgattatttttattatatctagatattgacaggcttggtgtaaagttaccttggtggtaggccaggtctcttgttcctgttcctgagccttcacctgtaccagaaccaggcaaaggaggctcagcacagccccaggccatccttatttccaagttcttctcagcaaggtctttcattgagagtgcttgcctaagggcacaatgctccttctgcctctcagatgagacacaaggcccttgctatggtgtaaatgcttaggcccccctagaattcatatgctgacatcctaacccccaaggtgatggtattaggaggtggggccttgggaggcaattaggtcagacaacagagccctcatgaatgggattagtgcctttataaaagagacccacagaatcaccacactgaagccttctcagtggaaagagctaagaagcacaggaaacacagaggccgaggtgggcggatcgcctgaggtgaggagttcaagaccagcctgaccaacatggagaaaccctgtctctactaaaaatacaaaattagatgggcgtggtggcgcatgcctgtaatcccagctactcaggaggctgaggcagaagaatcggttgaacctgggaggcggaggttgcagtgagccaagatcacgccattgcactccagcctgggcaacaagtgtgaaactccatctc

SEQ ID NO: 123128 - DNA, 4379 bp, Homo sapiens
  Payload ID: 4181
  Gene Symbol: CSMD2
  Gene Name: CUB and Sushi multiple domains 2
  Uniprot ID: Q7Z408
  ENST ID: ENST00000373380
  CDS Start-End: 222-3725
gagagacagacaaacagcacaagagacagaaacaaagcaggcagcaccataggtagggaagtattttttttttaagtttgagaggcatttctgtagacagtccaacaactggacagacacgcaggcaccttggcaggtagacaggcaaacgacttgtcatctttgtcaggttcttcagagctgtgagttgctttctggatgcagctgatgggggttaatctatggttattgtgattctctttccagctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgggcacttggcagctgtttgtacattgtgacacccctccacgcacacatctgccccccagccacagaagcttggaccagaggtggacacctgagctgactgcagcaggggcaatcagatgttctctcttgggaagttgaaataggacccaagagattctacttttgcctggacccatctcctgaaaagataaaaatccaagtgcaatggattgctgctcttctactttccatgtggaccaaaaagtagaacaatcctatgtgcagaaagagaatgattgagaagtggaaaaatttccttggtttctgatggcccttcagttcctcgtcctctacctttgtgaagtctggctgcaaacccacccttgggttctctcttctctgagaggcttttttgcttattctagcctgaattgatttatttacatccaaaggttcccaaggaatacaacaacctaggacccagcaatcctacttctgggaattatgcaaagatatgtgcatgaagatattgcttgatatgttataacagggaaattagaaataatctaaatgtaaaaatagtaagagattaggtattataaatttaaagtgtatactcagagagagagagatagggaaagatacagtcattacaaatcattcatgtatgaacctgggcaacatagtgagactctgcctctacc

SEQ ID NO: 123129 - DNA, 13698 bp, Homo sapiens
  Payload ID: 4181
  Gene Symbol: CSMD2
  Gene Name: CUB and Sushi multiple domains 2
  Uniprot ID: Q7Z408
  ENST ID: ENST00000373381
  CDS Start-End: 178-11073
gagagcgcagcgcgcctctccccggccgggcggacacttggttcattccagccgcagaagctcagggctcccgcgtaccgggattttttccgagcagaaaaaagctccagagctctcctgacctcctttctcctcggcggcgagcggagcctctccctcggcgctgccggccgcgccatgccgcgctcgcggggacgggagctggggcgctgcggctgccccgcggggagggctcgcggcgaaaccgggatttcggcgcttgtgccgggcgccgggagccgctggggccgcccgccgccgccaacgccgccgcctctgctgctgttgctgggctgtgggttgctcagcgtctcggccgccgcgggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgccactcagaccaagctccactccattttctataagctcctcttcgatgtactctcttccccatccctcaccaaagctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgccaattacctgtggacacccaggcaaccctgtcaacggcctcactcagggtaaccagtttaacctcaacgatgtggtcaagtttgtttgcaaccctgggtatatggctgagggggctgctaggtcccaatgcctggccagcgggcaatggagtgacatgctgcccacctgcagaatcatcaactgtacagatcctggacaccaagaaaatagtgttcgtcaggtccacgccagcggcccgcacaggttcagcttcggcaccactgtgtcttaccggtgcaaccacggcttctacctcctgggcaccccagtgctcagctgccagggagatggcacatgggaccgtccccgcccccagtgtctcttggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattggttttcttac

SEQ ID NO: 123130 - DNA, 13118 bp, Homo sapiens
  Payload ID: 4181
  Gene Symbol: CSMD2
  Gene Name: CUB and Sushi multiple domains 2
  Uniprot ID: Q7Z408
  ENST ID: ENST00000373388
  CDS Start-End: 30-10493
tcctgggatggggtaggaggctattgtgaatgaggctcataagcatcgcccccggccctagatggcaagttcaaagccaccacccaagatcagctggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggatttgacttactcccaccagatttcttccttcctgagaggttttgatctctcggagttggaaagaaccaactcaactcctcccgtcgccgcttcctatgtctgggatcttgatcctggttgtgaagcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgctggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattggttttcttac

SEQ ID NO: 123131 - DNA, 13430 bp, Homo sapiens
  Payload ID: 4181
  Gene Symbol: CSMD2
  Gene Name: CUB and Sushi multiple domains 2
  ENST ID: ENST00000619121
  CDS Start-End: 30-10805
tcctgggatggggtaggaggctattgtgaatgaggctcataagcatcgcccccggccctagatggcaagttcaaagccaccacccaagatcagctggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgccactcagaccaagctccactccattttctataagctcctcttcgatgtactctcttccccatccctcaccaaagctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgccaattacctgtggacacccaggcaaccctgtcaacggcctcactcagggtaaccagtttaacctcaacgatgtggtcaagtttgtttgcaaccctgggtatatggctgagggggctgctaggtcccaatgcctggccagcgggcaatggagtgacatgctgcccacctgcagaatcatcaactgtacagatcctggacaccaagaaaatagtgttcgtcaggtccacgccagcggcccgcacaggttcagcttcggcaccactgtgtcttaccggtgcaaccacggcttctacctcctgggcaccccagtgctcagctgccagggagatggcacatgggaccgtccccgcccccagtgtctcttggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattggttttcttac

SEQ ID NO: 123132 - DNA, 13212 bp, Homo sapiens
  Payload ID: 4182
  Gene Symbol: CSMD3
  Gene Name: CUB and Sushi multiple domains 3
  Uniprot ID: Q7Z407
  ENST ID: ENST00000297405
  CDS Start-End: 246-11369
tggtggttgctataacgagccagaattggggtagattttggtggaggggaaaaaacgcacaagaaaagacagaatccagagtagcggagactttgtgcccccgttggagagatggttgagtcctcgtcaaggttgctgtggtatcccagaaacaccattcactccgagctgtgaccgcgcaccaacaacagcaacaactccactgcgccgggctgaggagcaggaattaggagctcgcgaataatatgaaagggatccgcaaaggggaaagccgagcaaaggaatccaaaccctgggagcctggcaagcgaagatgcgctaaatgtggccgcctagacttcatcctgatgaagaaaatggggattaaaagtggatttacgttttggaacctcgtctttttattgacggtgtcttgtgtgaaaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaa

SEQ ID NO: 123133 - DNA, 10773 bp, Homo sapiens
  Payload ID: 4182
  Gene Symbol: CSMD3
  Gene Name: CUB and Sushi multiple domains 3
  ENST ID: ENST00000339701
  CDS Start-End: 1-8934
aaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgt

SEQ ID NO: 123134 - DNA, 13018 bp, Homo sapiens
  Payload ID: 4182
  Gene Symbol: CSMD3
  Gene Name: CUB and Sushi multiple domains 3
  Uniprot ID: Q7Z407
  ENST ID: ENST00000343508
  CDS Start-End: 172-11175
tacacccctcggccctttggaggaccggagagccggacgacgccgcagcccttgggggagtccagcgccagctggcgaaaagaagcttcatcttccagatcatccgggaaaggggcagaggtggccggttgttgcgactcataaacaacctcttcagcacaacccggttgaatgtggagttggttcctttgctggaaacctgtacagcttgaccgacagacagcctcaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaa

SEQ ID NO: 123135 - DNA, 12485 bp, Homo sapiens
  Payload ID: 4182
  Gene Symbol: CSMD3
  Gene Name: CUB and Sushi multiple domains 3
  Uniprot ID: Q7Z407
  ENST ID: ENST00000455883
  CDS Start-End: 30-10646
ggagcaggaattaggagctcgcgaataatatgaaagggatccgcaaaggggaaagccgagcaaaggaatccaaaccctgggagcctggcaagcgaagatgcgctaaatgtggccgcctagacttcatcctgatgaagaaaatggggattaaaagtggatttacgttttggaacctcgtctttttattgacggtgtcttgtgtgaaaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgt

SEQ ID NO: 123136 - DNA, 1368 bp, Homo sapiens
  Payload ID: 4183
  Gene Symbol: CUZD1
  Gene Name: CUB and zona pellucida-like domains 1
  ENST ID: ENST00000338948
  CDS Start-End: 333-476
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgca

SEQ ID NO: 123137 - DNA, 1976 bp, Homo sapiens
  Payload ID: 4183
  Gene Symbol: CUZD1
  Gene Name: CUB and zona pellucida-like domains 1
  ENST ID: ENST00000368900
  CDS Start-End: 333-491
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgca

SEQ ID NO: 123138 - DNA, 2125 bp, Homo sapiens
  Payload ID: 4183
  Gene Symbol: CUZD1
  Gene Name: CUB and zona pellucida-like domains 1
  ENST ID: ENST00000368901
  CDS Start-End: 333-491
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgca

SEQ ID NO: 123139 - DNA, 2903 bp, Homo sapiens
  Payload ID: 4183
  Gene Symbol: CUZD1
  Gene Name: CUB and zona pellucida-like domains 1
  Uniprot ID: Q86UP6
  ENST ID: ENST00000368904
  CDS Start-End: 951-2774
ccttctctctggactttgcatttccattccttttcattgacaaactgactttttttatttctttttttccatctctgggccagcttgggatcctaggccgccctgggaagacatttgtgttttacacacataaggatctgtgtttggggtttcttcttcctcccctgacattggcattgcttagtggttgtgtggggagggagaccacgtgggctcagtgcttgcttgcacttatctgcctaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggctcccttctcaaagcagagccctgaagacttcaatgatgtcaatgaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgtcactgt

SEQ ID NO: 123140 - DNA, 2279 bp, Homo sapiens
  Payload ID: 4183
  Gene Symbol: CUZD1
  Gene Name: CUB and zona pellucida-like domains 1
  Uniprot ID: Q86UP6
  ENST ID: ENST00000392790
  CDS Start-End: 333-2156
gaggccacctgtttgtgatgtgcaggcacagaagaaaggcacagctccccatcagtttcatggaaaataactcagtgcctgctgggaaccagctgctggagatccctacagagagcttccactgggggcaacccttccaggaaggagttggggagagagaaccctcactgtggggaatgctgataaaccagtcacacagctgctctattctcacacaaatctaccccttgcgtggctggaactgacgtttccctggaggtgtccagaaagctgatgtaacacagagcctataaaagctgtcggtccttaaggctgcccagcgccttgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgt

SEQ ID NO: 123141 - DNA, 2054 bp, Homo sapiens
  Payload ID: 4183
  Gene Symbol: CUZD1
  Gene Name: CUB and zona pellucida-like domains 1
  ENST ID: ENST00000545804
  CDS Start-End: 865-1935
cttactggggaaaggagagaccaagggctgcttcatgaaggctgtttctgagctgagctttgaacaatagcatgacgagggtaggtggaggtgggagtcagggaagaggactcacctctgctggagctgacagctgaggagtcatgggaagaaagggaggatagaacagaaggccatgaagtagtggcggatgagactggaaagctgagctggtgagagtgaggaagagccttcaagggagggtgtgactttattttctatggcgcaattcaggtaatgggagtctctccagatgcaacacatgttacagcacaactttaatatgattcgtttggcaatagtataaagattccctctctgccctgcaccagtggacagaaatttcaatgataaaaaaggatgaaaacctcaatatgtgacccatgggaaagatagagatggaatcatactcaggagagatgtgttaagctcaatgcacaacacagaaattaaaagcagtctctattttgatgttcattcttgaccaccttcacatccatttcagctattccaaactgtggcggttacctggataccttggaaggatccttcaccagccccaattacccaaagccgcatcctgagctggcttattgtgtgtggcacatacaagtggagaaagattacaagataaaactaaacttcaaagagattttaggccctcattctctagcctagaaatagacaaacagtgcaaatttgattttcttgccatctatgatggcccctccaccaactctggcctgattggacaagtctgtggccgtgtgactcccaccttcgaatcgtcatcaaactctctgactgtcgtgttgtctacagattatgccaattcttaccggggattttgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgc

SEQ ID NO: 123142 - DNA, 6006 bp, Homo sapiens
  Payload ID: 4184
  Gene Symbol: CDCP1
  Gene Name: CUB domain containing protein 1
  Uniprot ID: Q9H5V8
  ENST ID: ENST00000296129
  CDS Start-End: 136-2646
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacctattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagttccttcatcatcctggaagagccttttgccatgcaagacaacatagccacaggtggggattaggaccagaacatctttggggtgctgttattctgcctaccacaccttcctgccactgactcccacaggagaggctacaaaatgatctggcgcacagggatgttttgtttagcttgcggactctaacacttaaaaaaaaacccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacgtaaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactggaacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgcc

SEQ ID NO: 123143 - DNA, 1416 bp, Homo sapiens
  Payload ID: 4184
  Gene Symbol: CDCP1
  Gene Name: CUB domain containing protein 1
  Uniprot ID: Q9H5V8
  ENST ID: ENST00000425231
  CDS Start-End: 136-1167
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaagatgctaaattgtttttaacgaa

SEQ ID NO: 123144 - DNA, 2723 bp, Homo sapiens
  Payload ID: 4185
  Gene Symbol: CDCP2
  Gene Name: CUB domain containing protein 2
  Uniprot ID: Q5VXM1
  ENST ID: ENST00000371330
  CDS Start-End: 849-2198
ttcctgttggacacaaagtccccggggcatttctgcagcgccagctccttgtgcggggcctggcacatacgatgttcaagcaaggcttgggatcaataaaggagcgggcattccatattctcggccggaagttacactggctcccagacctattattgcattaagagttgcacaatacgattttccaattctgttattcctgctgcattcttgcgtgaaaaagacttttccctcaactgtctgcagcaacctccttccctcctctgagctaaatccgcatgtctgaaggaagttgtcctgcgtgtcccactaaatacaggctcctttcagctccctcggagtggggatgggaagaacctgtagcgagcacctactctgtgctttagcaagtgagatctcctttcatttgcacaacagcccctgggtcggagctgaacagccccactggatggatgagaagacccagaccaggggagttaaatgacttgtccaaggtgacctggcaagttacaggctgaactgggattgatcccagatctacccggccctaaaagttatgccctttctcctccactcactttccttccaggcctgagttccttcccttcctgatagtgtggtcggtgcagatctcagaacgtgtaaacctggtgacaccagatccgtcactttacagtgagtaaaggaagtacccagggatcggcttactaattctaggggccggtgaattattcatgccaccattaacttggaggccctttcagcctcacctctctttcccttgctccggaccctgagatcctggcctacctgagctcggcagacctgtgggggcccctggtgaggagatgctggcagagtggggggcttgcctgctgctggcagtggcactgctgggcccagggctccaggcccaagccatggaaggtgtcaaatgtgggggtgtgctctcagcaccttctggaaacttctccagccccaacttccctagactgtacccctacaacacagagtgcagctggctgatcgtggtggccgagggatcctcggtgctgctcaccttccatgcctttgacctagagtaccacgacacctgcagcttcgactttctggagatctacaatggggcctcaccagacaagggcaacctgctggggaggttctgcggcaaggtgcccccgccgcccttcacctcctcctggcatgtcatgtctgtcatcttccactcggacaagcatgtggccagccatggcttttctgcgggctaccagaaagatgtgtgtggcggcgtcctgactggcctgtcaggggtcctcaccagtcctgagtatcccaacaactacccgaacagcatggagtgccactgggtgatccgggccgctggccctgcccacgtcaagctggtgttcgtggacttccaggtggagggcaatgaagagtgcacctatgactacgtggctgtgcttggggggcctggccccacccgtgggcaccactactgtggcagcaccaggccccccaccctcgtgtctctgggccacgaactgcaggtggtcttcaagtccgacttcaacatcggaggccgtggcttcaaggcctactacttctcaggagaatgccaggaggtatacatggccatgcggggcaacttctccagcccacagtaccccagctcctaccccaacaacatccgctgccactggaccatccgcctgcccccgggctaccaggtcaaggtgttcttcctggacctggacctggaggagcccaacagcctgaccaagacctgtgactttgaccatctggcggccttcgatggggccagcgaggaggcacccctgctggggaattggtgtggacaccacctgccaccacccgtgacctcaagccacaaccagcttctgcttctgctgcacacagaccgcagcaccacccgcaggggcttctctgtggcctacatcggaggtcagctgggctgtgggagtgggtccactgagggcgaaggggaggctttgcagcctcagtctttgcagtctccttcctccatcccaccagtttgtcctgccccccccatgaatggtcttctccagctccttctccattggctacacccttgcccactctcgggacccctaagactggacggtacggctcccgcttgtttccactattgcagagcctccttccccagcttctaacttcgtgagtcctcacccctccccatctggttccttccccctgggcccctggcccctcttgtgttgttattggtcccctgtatccaggggaaatagacaaaatatggtaatattgtttatggcaaaaaaattggtataactgtggggatgtctaccagccctgcttgtatcattcagaactactcattgaaaacatggtgcttgtttttcctcactcaacaggaagcctggagctaggcagctgctgtattggtccaggggctcaacactgttccaaatgttatctctgggactctctgagcctcacagctgcaagatggctgccatagctccaggcatcgcatccatgttcaagactggaggggacaggggaagtgccagctgcaaatggctctttatcaagaaagcaaaagcatctctagaacctctcataagacttttacaaaatgtcccatcagtttgaactcagtcagatggccatgcctggctgcagaggaagctggggagctggtatttggctttctc

SEQ ID NO: 123145 - DNA, 705 bp, Homo sapiens
  Payload ID: 4186
  Gene Symbol: CUBN
  Gene Name: cubilin (intrinsic factor-cobalamin receptor)
  ENST ID: ENST00000377823
  CDS Start-End: 40-552
tggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaaggtgagtcatctactctttggttaagaatgatggcaggtcagcatctgtggtttccttggaatcatcaggcatatttaattctccatctaaagtttctaggattctgtggcctcccaaatcaaattgaaatataccaggtatgctaaaacccaaacagtggtgagtatgattgtataa

SEQ ID NO: 123146 - DNA, 11949 bp, Homo sapiens
  Payload ID: 4186
  Gene Symbol: CUBN
  Gene Name: cubilin (intrinsic factor-cobalamin receptor)
  Uniprot ID: O60494
  ENST ID: ENST00000377833
  CDS Start-End: 67-10938
ttctccaaaatcccatgctcagttggttggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgttttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataacggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagaaatcatcgtgttctcttgaacttcactgactttgatcttgaaccacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaagcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcgtcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcagggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctgttctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttcgctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacatacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattctaatattttgagctgaaatttaaaaaaactttgaaagagttggaaatgattatggcatatgtgacatacatttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaatt

SEQ ID NO: 123147 - DNA, 599 bp, Homo sapiens
  Payload ID: 4186
  Gene Symbol: CUBN
  Gene Name: cubilin (intrinsic factor-cobalamin receptor)
  ENST ID: ENST00000438254
  CDS Start-End: 1-267
agcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagaaatcatcgtgttctcttgaacttcactgactttgatcttgaaccacaagactcttgtattatggtttaatcatacttggtcggacgtcagacagatggggtttgtatattggctctgcactgctaagcgtgtgattgggcaagtcatgtatgttttcagagctcagttttccctgctgcaaagtggaactgtaagaatcaaatgtaaacaaatgtatttaagtacctatcagtgtctggttcagataagtatttgctgctattcctaatttttctattacaatgactcctgcttctattactattaacgctatgttaaagatcttaaggaatcttttaaaaaaattttctccctgagcaagatgaaacttagtaaacaagataaaaaatccagtagaaaaa

SEQ ID NO: 123148 - DNA, 958 bp, Homo sapiens
  Payload ID: 4186
  Gene Symbol: CUBN
  Gene Name: cubilin (intrinsic factor-cobalamin receptor)
  ENST ID: ENST00000433666
  CDS Start-End: 1-318
aattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagaaatccttgctctaacatccccaaggaaccggaagaaggctcccgtgattggcacagagagtaagcatggcctggtgcaaaaggagctgaagacttaggaagagccggagcattgaaggggagccactgaatggccttaagtagaaaaggggacaccccaccacaccagtgtccccagctgtactctttccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcctgctcagctcaggcatcactttctgcaggaaactttcccttccctttttaagcagagtgaggcatctcagggcctctatgttcccatcatgctctagggatatccatcgtcaaagctttgctgatgccacacacattgtctttctaaaaacgaagtccaaaaaattaaggcagatcaatgccaaacttacttttgtacagttctttgaagtcaccttttaaactagacagtgtctttccttatagtttggctggtctcttttattttgtgatttttaaaagattaataaataaattctgctatagaatgaacaaa

SEQ ID NO: 123149 - DNA, 2193 bp, Homo sapiens
  Payload ID: 4187
  Gene Symbol: CUEDC1
  Gene Name: CUE domain containing 1
  Uniprot ID: Q9NWM3
  ENST ID: ENST00000360238
  CDS Start-End: 720-1880
aagtgtggccacttcctcttgcctggcctgactcaccctggctgctgcccattgtggctgccatggaaatacaactcgaggagaacccagaccaggacagggaggccatgttctgggtggcagtggagcctggcaaggtgccctcctggcctgggactgctgtggcagaggaagcatgaggtggggcctggcctgcccagctcagagctgaggtgcccccttggttttttacctccctgttccctggctggcccactgcacccacgcactcaacgcagtggcttcgctcctcctccaggatggctggaggtgggaccattgccaggatggcctcaagtgcccagccctcctggaagactcagtttccctctttgtcccatgcagaggtgcagagattcattattgtgggaccatccgtgaaaccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctcccttt

SEQ ID NO: 123150 - DNA, 2190 bp, Homo sapiens
  Payload ID: 4187
  Gene Symbol: CUEDC1
  Gene Name: CUE domain containing 1
  Uniprot ID: Q9NWM3
  ENST ID: ENST00000407144
  CDS Start-End: 437-1597
gctgccagggcctgagctctgggacaccacctagtggcctggcttggcagcgccactgggctgtgccagatcttaggcaagaagcaaatccctctgcaggcaggcatcacggcagtcacagatggacgtagggtctgctccttggtgattttcagaggagggagcctggggtgcacagagacagagctgcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgg

SEQ ID NO: 123151 - DNA, 486 bp, Homo sapiens
  Payload ID: 4187
  Gene Symbol: CUEDC1
  Gene Name: CUE domain containing 1
  ENST ID: ENST00000581898
  CDS Start-End: 1-160
ggagagagatcgattgaaatacgaatcccagaaatctaaatccagcagcgtggctgtcggaaacgactttggcttttcctctcctgtcccagatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaa

SEQ ID NO: 123152 - DNA, 512 bp, Homo sapiens
  Payload ID: 4187
  Gene Symbol: CUEDC1
  Gene Name: CUE domain containing 1
  ENST ID: ENST00000585294
  CDS Start-End: 1-127
gctgggggctgccgcgtcaacagccaacctcctggatgatgtggagggccacgcgtgtgatgaagacttccggggcaggcgtcaggaggcacccaaggtggaggaaggcctgcgagaaggacagtaagaggaaccagtgaccaggaaagaccattgggctcctttgaaaaagattcctcccatcccttttttcccctaccagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctcccttt

SEQ ID NO: 123153 - DNA, 3621 bp, Homo sapiens
  Payload ID: 4187
  Gene Symbol: CUEDC1
  Gene Name: CUE domain containing 1
  Uniprot ID: Q9NWM3
  ENST ID: ENST00000577830
  CDS Start-End: 415-1575
ggccccgccgccaccgctgcggattgcagcccctcccccgcccggcccgcggcccggcccctgcggcccgcgcggagcggacgcgcgtggcgctgcccggtgggaccatccgtgaaaccggtgccaggatgcaccgggggtgtggatgaccggccgcccagccccagcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtaagcggctgacggcggaaagaccctggggaaggggctttgcggccggctagaaacattttccccaagcggctccgcaaaatgaccagcctgttccgccggagcagcagcggcagcggcgggggtggcaccgccggggcacgcgggggcgggggaggcacggccgccccccaggagctcaacaacagccggcctgcccgccaggtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctcttccttgccagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggcccctataggcagcagccaattacagccccttttgtagccaggcgttcctatggtcaaagagtggaaatgcaggaaccaacctccctttaaaaaaaaaaaaatccagaaagcagataaaagttggaatatggaaaagggcaagatgacccccaccagaggctctttggcctgaaggtggagtctctgcctccgtccgttctctatctctcctgtcacagactctgcctgaccccctttcctcagctcccttctggtcccccttcctcagctccctccgggcacttgtgcccttcccttccatgtcctcctgtatctcagccttcccccggggctgctggcccagcacacgagccctgcacccagcctgggtgggaggtccctggccagtcccccaggaactctgaggagctatgggctactgcaaagcatctgccgactgccctgccccgtctggcctcatcaggctgctgctgttagggatgggctcactcccagcagctcccggtcacccagcagggatggggagggtggccaccctggagctggaggactctggggaggcagggtctttaatttggcagcagacaaaagccagttctggagtcacaccacagtaggggctcacaggggctctgactccccagctggactggaagccctgctgtccgagggtgggcagcggtgggtcctggagtgacccctttgagcaggtgcagggctaaagagcaaggcggaaaggccgccagcctgggtgagcgcctagggcataagggcttgctgggtgcccctgagaagggcgggtgatctgaggaggagaactctgattctaggaacgcttacacggcactgaccactgccacggggagggaggctgcccagcccgtggccccgccctggacatgggagcgcgcagaccttccggagagccgggaagcctgggcaggcacgaggcttcggcgcggctctgggaggttgggagtggcatccgatccttggccgggccctggtggcctccgtggccccaagatcacaagggcgtagcgaaggcgagccggcgatcgcacctcgtcccgcccaccctgcccggactcgcaacgccgagcttggggagggccgggacgcgcagccgccgccgagcgtgaccaagtttggaaacgcgcgcggggccgggacgctggctcggggggccctgccgaggagcggtcgccccctccgctgctccccgcgccaggcctggggccctggagggaggggggggggtctccgaggagtgcctcggtaccccagctcgagttctcgacgggtctctgagccttccccgcgccaggacccggcgcactgtgggggaagccccagccccatgtctgttgagtgttgctttgttattttttttcctcctatgtgtgggttttttcttggagctgtttcataggaattcctgtaataaacagttggtgttctcttggtgctctgatgtggccagcggcgtgggctggaccctcctgctccctcctccctcccggcctggggcagggtttgtccccaggagccccgcgtcgcatccctagggtacccctgccttgcctggcccattcacccgcggcgctctccgactgcactctcgaggtgacacctgcggcaccgctgcacctcaaccttgcggacctgccggctgcgtctagcgctgtcgccttcctgtttggcccaggactgtaaaccgcttgctgtatcaggcaagggaaacaccatggggaaagccagtctgttgagaaagctccagacggccacctccctaaataaacagcttctggattaaaggca

SEQ ID NO: 123154 - DNA, 705 bp, Homo sapiens
  Payload ID: 4187
  Gene Symbol: CUEDC1
  Gene Name: CUE domain containing 1
  ENST ID: ENST00000577589
  CDS Start-End: 220-705
gtggatgaccggccgcccagccccagcacggcccggtcccgcatgccaccgccccgcgaggaccgctctccaagggctgcctggggccccgcgcccgtactctcctaacccggagctcttggcagcccattgctgcctggctacccggggaggaggaggcgcaggagtgagctgcccgagaccgcagggcaagtgcgccgcctggagttcaaccaggccatggacgacttcaagaccatgttccccaacatggattacgacatcatcgaatgcgtgctgcgcgccaacagcggcgctgtggacgccaccatcgaccagctgctgcagatgaacctggagggcggtggcagcagcggcggcgtctatgaggacagctccgactcggaggacagcatccccccggagatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtcca

SEQ ID NO: 123155 - DNA, 875 bp, Homo sapiens
  Payload ID: 4187
  Gene Symbol: CUEDC1
  Gene Name: CUE domain containing 1
  ENST ID: ENST00000577840
  CDS Start-End: 109-858
cccgcgcggagcggacgcgcgtggcgctgcccgatcttggaaaggactttggaacctgatagctcggatgaagagcccccacctgtgtactccccgccagcctaccacatgcacgtgttcgaccggccctaccctctggctcccccgactccgcctccccgtatcgacgcgctgggctctggagcccctacaagccagagacgctatcggaactggaacccaccactgctgggcaaccttccggatgactttctccgcatcctgccccagcagctggacagcatacagggtaacgctgggggccccaagcctgggagtggagagggatgtccacctgccatggctgggccagggcccggagaccaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgccgcgtcaacagccaacctcctggatgatgtggagggccacgcgtgtgatgaagacttccggggcaggcgtcaggaggcacccaaggtggaggaaggcctgcgagaaggacagtaagagatgccagcagctct

SEQ ID NO: 123156 - DNA, 1191 bp, Homo sapiens
  Payload ID: 4188
  Gene Symbol: CUEDC2
  Gene Name: CUE domain containing 2
  Uniprot ID: Q9H467
  ENST ID: ENST00000369937
  CDS Start-End: 147-1010
gcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaggtg

SEQ ID NO: 123157 - DNA, 2112 bp, Homo sapiens
  Payload ID: 4189
  Gene Symbol: CELF1
  Gene Name: CUGBP, Elav-like family member 1
  Uniprot ID: Q92879
  ENST ID: ENST00000310513
  CDS Start-End: 137-1585
ggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcact

SEQ ID NO: 123158 - DNA, 2108 bp, Homo sapiens
  Payload ID: 4189
  Gene Symbol: CELF1
  Gene Name: CUGBP, Elav-like family member 1
  Uniprot ID: Q92879
  ENST ID: ENST00000358597
  CDS Start-End: 1-1461
atgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaa

SEQ ID NO: 123159 - DNA, 1580 bp, Homo sapiens
  Payload ID: 4189
  Gene Symbol: CELF1
  Gene Name: CUGBP, Elav-like family member 1
  Uniprot ID: Q92879
  ENST ID: ENST00000361904
  CDS Start-End: 12-1463
gctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctctt

SEQ ID NO: 123160 - DNA, 7666 bp, Homo sapiens
  Payload ID: 4189
  Gene Symbol: CELF1
  Gene Name: CUGBP, Elav-like family member 1
  Uniprot ID: Q92879
  ENST ID: ENST00000395290
  CDS Start-End: 11-1468
ctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataaaaaagaaaaaagaaaacaaaaaaaaaaaagaaaaaaatgctaggttggggaggcgctgttctgaatcccaaccggctggaaccaagaatgtcgtttctatttttatagaagttttatacagctccggggtggagaatatttattacctaaattatatctctggaaaaggccaggattttgtagaatccagaatgtgattgttatacacacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgttctgtcttcctccttagccagaacgccactcccttcccacatccccttcttctctccgccttcccccatctcaccattatttgtccatggatttgtcctgggctctgggaccttatgaaacccctttcctaatgacataagaggccaaggtgcaatccacccacctttgataccagaccctgagggcttcatacctgctgatgggttttcttttctaaaaggaatgctcgccccagcagggtcctgggctgcttgagcagccagctggtgagaccatgcacttctctgttctctcctccccctgcccagtgagttagcacagcagtagcactgcccttgagcacagttctttccccaggccaaagatggttttgtgaagaagctgctcccctacaagtctcacgtgtgaaagggctcagctcagagtggagactcgctgtcaagtcttaagcaatccttttctgttgtgtgaaggtttcacttacaatgtgttttctgctgtagttttgtttcttacttgggttacatcatgaaattgatttgccttgaatgcagccagaccactgtctcctgggttccccttgagtggccagggcctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtgaagagaaaaaaaaattgccactatgaccaaacgcacagtctgttctgcagcaacaacgggattcaatcaactcagtcgtgattcagccgtagaaatgcttttcctttatcttgtttgagcttttcctttctttcctgttttgatttgcaaaagaaaatgtcttttttgtgtgaacttgtgttgtactctgtagaaaattatggattttactttaatggtttaaaaaaaggcaaggagagccctcgtcgcttttcttacctaatcacagagtttgtgtagtgaatttaaaaagaaaaaaaaattgttataagtttggagcaagggagtatgtgtttcaaaggaatctccttcctttttttgtgtgtttttccttttgtcccaatggggaacctaaatctgttttaattgcacagacacatggacaaaaagtcattttgtatctgccaagtgtggtaccttcctttgtttatttgctattaaactgtttg

SEQ ID NO: 123161 - DNA, 2191 bp, Homo sapiens
  Payload ID: 4189
  Gene Symbol: CELF1
  Gene Name: CUGBP, Elav-like family member 1
  Uniprot ID: Q92879
  ENST ID: ENST00000395292
  CDS Start-End: 202-1653
atactttgaaaataacagctcttttttgttccctcgtgtgtctcttcccaattgtatccctattgtattttctcatagtatgtttcagcagaaatcaaggtagacgaagtaacctcttgtcctgaattttcatagttgctcattcttaataatggcagcagaagcaacaatgagagtaactacctcctcagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctga

SEQ ID NO: 123162 - DNA, 583 bp, Homo sapiens
  Payload ID: 4189
  Gene Symbol: CELF1
  Gene Name: CUGBP, Elav-like family member 1
  ENST ID: ENST00000530151
  CDS Start-End: 298-583
ctctcgcgggctcgcaccgggtgacggcggggactggcctggactctgggggactggcgggactctggaggagggcccggcggcctcggaggagggaccgaggtttcctgggcgggaaactgggaccccggcgaagggagagcgcgtcgcaggccagacacgtgtgagccctgtagcgtgggaaactgaggcccccgcctgtggccggtgacctccctcctccgagggaggggggttgtgaccccagagtgaagacatagtccagagagggaagtgtaaagctacagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaac

SEQ ID NO: 123163 - DNA, 543 bp, Homo sapiens
  Payload ID: 4189
  Gene Symbol: CELF1
  Gene Name: CUGBP, Elav-like family member 1
  ENST ID: ENST00000528434
  CDS Start-End: 202-543
atgctggagaaacaccttgattgaggcagcttcttctgtggctgtgtggctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccaggg

SEQ ID NO: 123164 - DNA, 476 bp, Homo sapiens
  Payload ID: 4189
  Gene Symbol: CELF1
  Gene Name: CUGBP, Elav-like family member 1
  ENST ID: ENST00000526419
  CDS Start-End: 307-476
gcgagaagagcaggcgggtgccggggcggggctgccagctgcactaggcctctcgcgggctcgcaccgggtgacggcggggactggcctggactctgggggactggcgggactctggaggagggcccggcggcctcggaggagggaccgaggtttcctgggcgggaaactgggaccccggcgaagggagagcgcgtcgcaggccagacacgtgtgagccctgtagcgtgggaaactgaggcccccgcctgtggccggtgacctccctcctccgagggaggggggttgtgaccccagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctca

SEQ ID NO: 123165 - DNA, 3044 bp, Homo sapiens
  Payload ID: 4189
  Gene Symbol: CELF1
  Gene Name: CUGBP, Elav-like family member 1
  Uniprot ID: Q92879
  ENST ID: ENST00000532048
  CDS Start-End: 895-2433
gtctgtttaaggaatagcagaagacatgacatgtagacaaatttcaggttattttcagaagatactgggtttgttactgtattttaaaaggatactttcttggtttgttatgagatattctaattaaacagtgatgaattcttactcctggtcagtgtaagtctaaattcaagtttgttgctttgttttacagtttcctttcactcccctcccccatcccctcatgagtcataagcatgcagtgttgggaatagaacttgtcagctgagtggggatgagacagttctctgcccatactatttgtaactgtagtcaatgaggagaggaaaggacgttattaaatgctggagaaacaccttgattgaggcagcttcttctgtggctgtgtggtatggatgcagagttctgtgtgactatacactgatgtattctggctctgaatcacttagggatctcttctgcaccttgtgcattgtaggttttggatgcttatttgtttagggtctaggacctggtgcttagcctctcctggatcctgtatatttactgactttccaaattcttttgagtgtggcattatatctgcttcatcttctctttcttggctattcttagtgcccttctcattttactgtcctaatgttttcccatttatactatgaatcattgtgcaccctatgtagagcctgtcattggagattaaaatcagtggcagctctttgattttacagctcagcctcagctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaat

SEQ ID NO: 123166 - DNA, 622 bp, Homo sapiens
  Payload ID: 4189
  Gene Symbol: CELF1
  Gene Name: CUGBP, Elav-like family member 1
  ENST ID: ENST00000525841
  CDS Start-End: 362-622
accgggtgacggcggggactggcctggactctgggggactggcgggactctggaggagggcccggcggcctcggaggagggaccgaggtttcctgggcgggaaactgggaccccggcgaagggagagcgcgtcgcaggccagacacgtgtgagccctgtagcgtgggaaactgaggcccccgcctgtggccggtgacctccctcctccgagggaggggggttgtgaccccagagtttcactattgtcacccaagctgcagtgcaatggcgtgatctcagcacactgcaacctctgcctcccaggttcaagcaattctcctgcctcagcctcccgagtagctgggattacagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccaggg

SEQ ID NO: 123167 - DNA, 3650 bp, Homo sapiens
  Payload ID: 4189
  Gene Symbol: CELF1
  Gene Name: CUGBP, Elav-like family member 1
  ENST ID: ENST00000531165
  CDS Start-End: 280-1824
ggcagcggcagcggcggcgggacgcggaggctcccccgggattcggcctcagcagcgaggcggcggcggcggctgcggaggcgcaggcagcaactgaggcagcggcaggctcaggtgcagccgctggctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctggcacagcttgccctgaagactcggctactgccttctgtgggagtttcgcttcgtacagaggacaagtttgtgctttggtttccagtgttttactttggagtttaggtgccatatcctgaggttttttttgtttttgtttttgtttctcctttatttaaagtttgctgtgtttgtaaccagtgtgtgttgagaaggaccaacaccaaaccaccctggggaagggggacagggaaacatttaacacagacgatgatcaggatttgccccaaaccaccccaagagagaggactgagtggaacaaaaaagtgacccccagaacctctcttagtgtgagggtgggtagaatgagaactgacacctgggagctgtggggagcagagcggctttggggaagagtggagtgactagacacctaatgccctggcagctggagactcaaactcctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcctggctggtggcagtttgggagaaacagccaaagaggttagtttatttcaacaccaaattagaccatggcccatttccaacgggtctctttaaaggcctctatggaatacattgcctggtttccttctttgcagttcaccacagcaaggaatgtcacctccatcccaagccaccattttctcatgaaggcaaatccaagaagggcttgcagttcttgctgaagggggtaccatttgtgggcagagtgatcaataccatctagttgggggaggaggagcttatttcttggtgtacttgaatcagaaggtccctgcaagccagtatgcttcatttgccagtggccagaaattctcccttgcctccttgattgaggtgtcccagatgtagtattcccacaggggtctggcaggcccctcctgtaaccactccagtcacattttctgctcttgaggcagaggtgacatcaggacgtttacagcctccacatgaattgagtgttcatttacctcagtattaccgtgttcatttttgtcctcgtgctacagttagctccctgccgcctcttgcaggtcttacttcagctcttgcctgtgacccacacagcttctgggctctgcctctgctctaagaagtgctgtgggggtagagaaccaggaaggacatgctgttgggaatgtacacctgggcagaggtggccctgttaagatgtgactgtagccacagccagggatgggatccctgggtctctggaatctgaaacctcaacaaataccagtcttgacccctagcagcagagataagaataaaggggttggtttgctattaagtcagatgggggctctctccttgtcatgctgtccctgtgggtaacagacagggattgaccatcttactgttgtacaggtagctggtggtgttggattatcccattgaagctgggacagctgttcctttctcatagtgataacttgggtctgttgtcctctaaggaacgtgaaacatacacttcttaagctgaaccacgtaaacttgaaattctgcgcactgggagaaatgtgtcctgtgtttcaaaggataaaactgttctaaaggcttccagggtcatgatgggattttttaaataaatgcaaaaaataaaaataa

SEQ ID NO: 123168 - DNA, 549 bp, Homo sapiens
  Payload ID: 4189
  Gene Symbol: CELF1
  Gene Name: CUGBP, Elav-like family member 1
  ENST ID: ENST00000535982
  CDS Start-End: 241-549
attgtgtgctgggctgagcctcccttcacatggtcacatccccattttaatccaatactccctttccctaccccttccccagtcctgcctctttctgtggcacttattgctggtttccctgagctcctgtttccactttgtgttttttgtggggcccaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcag

SEQ ID NO: 123169 - DNA, 556 bp, Homo sapiens
  Payload ID: 4189
  Gene Symbol: CELF1
  Gene Name: CUGBP, Elav-like family member 1
  ENST ID: ENST00000526277
  CDS Start-End: 444-556
atctcttctgcaccttgtgcattgtaggttttggatgcttatttgtttagggtctaggacctggtgcttagcctctcctggatcctgtatatttactgactttccaaattcttttgagtgtggcattatatctgcttcatcttctctttcttggctattcttagtgcccttctcattttactgtcctaatgttttcccatttatactatgaatcattgtgcaccctatgtagagcctgtcattggagattaaaatcagtggcagctctttgattttacagctcagcctcagctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaacc

SEQ ID NO: 123170 - DNA, 581 bp, Homo sapiens
  Payload ID: 4189
  Gene Symbol: CELF1
  Gene Name: CUGBP, Elav-like family member 1
  ENST ID: ENST00000528538
  CDS Start-End: 539-581
actagctaggccgtgtggccaccctttggcacccgcaccggctcagacctgctcaggactcagccagggcacacagtttgtgttcttacgtgcatccatctgtctgtctgtgtgcgtctctgtggaggactgaggttttcaagtgaaagagagtgaagacatagtccagagagggaagtgtaaagctacaggctgaacataacttctttttttcaaagttccctgtgttgtgaactgagcttgggtgaagtgaaatctttgaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgttatgtttcagcagaaatcaaggtagacgaagtaacctcttgtcctgaattttcatagttgctcattcttaataatggcagcagaagcaacaatgagagtaactacctcctcagctcaaagaaaatgaacggcaccctggaccacccagaccaaccagatcttgatg

SEQ ID NO: 123171 - DNA, 576 bp, Homo sapiens
  Payload ID: 4189
  Gene Symbol: CELF1
  Gene Name: CUGBP, Elav-like family member 1
  ENST ID: ENST00000543178
  CDS Start-End: 341-576
agttccctgctcctccctctctgagcacggagcagaatctgttctgctgaagctgctgttccactttttagcttgctatatttgtacagcaacagcaggagcagcccactagctaggccgtgtggccaccctttggcacccgcaccggctcagacctgctcaggactcagccagggcacacagtttgtgttcttacgtgcatccatctgtctgtctgtgtgcgtctctgtggaggactgaggttttcaagtgaaagaggctgaacataacttctttttttcaaagttccctgtgttgtgaactgagcttgggtgaagtgaaatctttgagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctct

SEQ ID NO: 123172 - DNA, 1754 bp, Homo sapiens
  Payload ID: 4190
  Gene Symbol: CELF2
  Gene Name: CUGBP, Elav-like family member 2
  ENST ID: ENST00000354897
  CDS Start-End: 20-1528
taacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtaccatcaacactcccagaagcaaaaggcttttacttccaaaagataacaacggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctcca

SEQ ID NO: 123173 - DNA, 7085 bp, Homo sapiens
  Payload ID: 4190
  Gene Symbol: CELF2
  Gene Name: CUGBP, Elav-like family member 2
  Uniprot ID: O95319
  ENST ID: ENST00000399850
  CDS Start-End: 308-1780
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccgtttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaata

SEQ ID NO: 123174 - DNA, 8044 bp, Homo sapiens
  Payload ID: 4190
  Gene Symbol: CELF2
  Gene Name: CUGBP, Elav-like family member 2
  Uniprot ID: O95319
  ENST ID: ENST00000417956
  CDS Start-End: 308-1780
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttggaaacaaaa

SEQ ID NO: 123175 - DNA, 6894 bp, Homo sapiens
  Payload ID: 4190
  Gene Symbol: CELF2
  Gene Name: CUGBP, Elav-like family member 2
  Uniprot ID: O95319
  ENST ID: ENST00000416382
  CDS Start-End: 68-1594
cgactgtggcattgatgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccgtttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcc

SEQ ID NO: 123176 - DNA, 7982 bp, Homo sapiens
  Payload ID: 4190
  Gene Symbol: CELF2
  Gene Name: CUGBP, Elav-like family member 2
  ENST ID: ENST00000542579
  CDS Start-End: 161-1726
ggggattggcggagcgcgaggagagaatgtgacaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcaggccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtgaaatctctcccagtaggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaacacactgcctacgttagtgggaaaggatggctaagggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttgg

SEQ ID NO: 123177 - DNA, 1549 bp, Homo sapiens
  Payload ID: 4190
  Gene Symbol: CELF2
  Gene Name: CUGBP, Elav-like family member 2
  ENST ID: ENST00000609870
  CDS Start-End: 22-234
agtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaagatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccac

SEQ ID NO: 123178 - DNA, 2210 bp, Homo sapiens
  Payload ID: 4190
  Gene Symbol: CELF2
  Gene Name: CUGBP, Elav-like family member 2
  ENST ID: ENST00000609692
  CDS Start-End: 22-1344
agtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtaccatcaacagtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttactt

SEQ ID NO: 123179 - DNA, 1892 bp, Homo sapiens
  Payload ID: 4190
  Gene Symbol: CELF2
  Gene Name: CUGBP, Elav-like family member 2
  Uniprot ID: O95319
  ENST ID: ENST00000608830
  CDS Start-End: 198-1664
gatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtaccatcaacagtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaat

SEQ ID NO: 123180 - DNA, 3827 bp, Homo sapiens
  Payload ID: 4190
  Gene Symbol: CELF2
  Gene Name: CUGBP, Elav-like family member 2
  Uniprot ID: O95319
  ENST ID: ENST00000632728
  CDS Start-End: 109-1581
gacggagctctggtggccggggggaaagagctcttcttaccaaattacccgctcatctgatttaatatttgcaaagatcctttcctaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccgtttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaa

SEQ ID NO: 123181 - DNA, 1803 bp, Homo sapiens
  Payload ID: 4190
  Gene Symbol: CELF2
  Gene Name: CUGBP, Elav-like family member 2
  ENST ID: ENST00000631816
  CDS Start-End: 12-1556
agtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaa

SEQ ID NO: 123182 - DNA, 1952 bp, Homo sapiens
  Payload ID: 4190
  Gene Symbol: CELF2
  Gene Name: CUGBP, Elav-like family member 2
  ENST ID: ENST00000632065
  CDS Start-End: 125-1726
tgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtaccatcaacactcccagaagcaaaaggcttttacttccaaaagataacaacggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctcca

SEQ ID NO: 123183 - DNA, 1496 bp, Homo sapiens
  Payload ID: 4190
  Gene Symbol: CELF2
  Gene Name: CUGBP, Elav-like family member 2
  ENST ID: ENST00000633200
  CDS Start-End: 54-338
atgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaagatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtaccatcaacagtgagtatttgctgctctggtggacagccttcccccaaattctccacagaaagtggtcagccagaaatgacccgaaaaaggatatgccacggggagaactaaaacttgggatggaggagcacatgctttgataggcaaaagctgtctacactcgttttgcctcagaaaatccccaaccactctccacccccagattctcttcagtgtgtagcacagcgcgtgtgctcatccatggggttctgtggctggcagctcttttcaggtttccaggagtttggtttggtttggtttcggtcggttctgtcctgcgaggcagggtgttacggtgggaaaagttaatggactggaaggctggaagcctgaacccagctctgctgccaggcagctgtgggaagtcaggcagatgctgctccctctctgggcttgggagtctccatttgagaatggaaagttctgggtcagatgattcttaaaggtagcctccagctccaaagtctaaagattcatgacaattaaata

SEQ ID NO: 123184 - DNA, 5538 bp, Homo sapiens
  Payload ID: 4190
  Gene Symbol: CELF2
  Gene Name: CUGBP, Elav-like family member 2
  Uniprot ID: O95319
  ENST ID: ENST00000631460
  CDS Start-End: 65-1591
ctgtggcattgatgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaata

SEQ ID NO: 123185 - DNA, 1733 bp, Homo sapiens
  Payload ID: 4190
  Gene Symbol: CELF2
  Gene Name: CUGBP, Elav-like family member 2
  ENST ID: ENST00000633077
  CDS Start-End: 168-1733
tttcggaggggattggcggagcgcgaggagagaatgtgacaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactga

SEQ ID NO: 123186 - DNA, 3246 bp, Homo sapiens
  Payload ID: 4191
  Gene Symbol: CELF3
  Gene Name: CUGBP, Elav-like family member 3
  Uniprot ID: Q5SZQ8
  ENST ID: ENST00000290583
  CDS Start-End: 795-2192
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagc

SEQ ID NO: 123187 - DNA, 2335 bp, Homo sapiens
  Payload ID: 4191
  Gene Symbol: CELF3
  Gene Name: CUGBP, Elav-like family member 3
  Uniprot ID: Q5SZQ8
  ENST ID: ENST00000290585
  CDS Start-End: 33-1280
ctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagca

SEQ ID NO: 123188 - DNA, 2444 bp, Homo sapiens
  Payload ID: 4191
  Gene Symbol: CELF3
  Gene Name: CUGBP, Elav-like family member 3
  ENST ID: ENST00000420342
  CDS Start-End: 1-1400
ttgttgaggagagcgcggccggagagcagagctccgggacccagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaa

SEQ ID NO: 123189 - DNA, 3542 bp, Homo sapiens
  Payload ID: 4192
  Gene Symbol: CELF4
  Gene Name: CUGBP, Elav-like family member 4
  Uniprot ID: Q9BZC1
  ENST ID: ENST00000334919
  CDS Start-End: 1-1347
atgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggagaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaaggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 123190 - DNA, 1853 bp, Homo sapiens
  Payload ID: 4192
  Gene Symbol: CELF4
  Gene Name: CUGBP, Elav-like family member 4
  Uniprot ID: Q9BZC1
  ENST ID: ENST00000361795
  CDS Start-End: 125-1579
agagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcaatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaag

SEQ ID NO: 123191 - DNA, 4052 bp, Homo sapiens
  Payload ID: 4192
  Gene Symbol: CELF4
  Gene Name: CUGBP, Elav-like family member 4
  Uniprot ID: Q9BZC1
  ENST ID: ENST00000420428
  CDS Start-End: 397-1857
gtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 123192 - DNA, 1461 bp, Homo sapiens
  Payload ID: 4192
  Gene Symbol: CELF4
  Gene Name: CUGBP, Elav-like family member 4
  Uniprot ID: Q9BZC1
  ENST ID: ENST00000591282
  CDS Start-End: 1-1461
atgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactga

SEQ ID NO: 123193 - DNA, 3757 bp, Homo sapiens
  Payload ID: 4192
  Gene Symbol: CELF4
  Gene Name: CUGBP, Elav-like family member 4
  Uniprot ID: Q9BZC1
  ENST ID: ENST00000591287
  CDS Start-End: 108-1562
gagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcagcagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 123194 - DNA, 426 bp, Homo sapiens
  Payload ID: 4192
  Gene Symbol: CELF4
  Gene Name: CUGBP, Elav-like family member 4
  ENST ID: ENST00000593271
  CDS Start-End: 13-426
gcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtcctgcctaccctgctgcctatggtcagataagccaggcctttcctcagccgcctccaatgatcccccagcagcagagagaaggcttcgtgagcttcgacaacccggccagcgcgcagaccgccatccaggccatgaacggcttccagatcggcatgaagaggctcaaggtgcagctgaagcgg

SEQ ID NO: 123195 - DNA, 556 bp, Homo sapiens
  Payload ID: 4192
  Gene Symbol: CELF4
  Gene Name: CUGBP, Elav-like family member 4
  ENST ID: ENST00000589386
  CDS Start-End: 13-556
gcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggtaatgtcatctcctcgaaagtgtttgtggatcgggcgactaaccaaagtaaatgctttggcttcgtgagcttcgacaacccggccagcgcgcagaccgccatccaggccatgaacggcttccagatcggcatgaagaggctca

SEQ ID NO: 123196 - DNA, 592 bp, Homo sapiens
  Payload ID: 4192
  Gene Symbol: CELF4
  Gene Name: CUGBP, Elav-like family member 4
  ENST ID: ENST00000589229
  CDS Start-End: 106-592
agtgcacgggagagaaagagaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctga

SEQ ID NO: 123197 - DNA, 2542 bp, Homo sapiens
  Payload ID: 4192
  Gene Symbol: CELF4
  Gene Name: CUGBP, Elav-like family member 4
  ENST ID: ENST00000586009
  CDS Start-End: 1-347
caggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtcgcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 123198 - DNA, 410 bp, Homo sapiens
  Payload ID: 4192
  Gene Symbol: CELF4
  Gene Name: CUGBP, Elav-like family member 4
  ENST ID: ENST00000587657
  CDS Start-End: 13-410
gcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcagcagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcgg

SEQ ID NO: 123199 - DNA, 329 bp, Homo sapiens
  Payload ID: 4192
  Gene Symbol: CELF4
  Gene Name: CUGBP, Elav-like family member 4
  ENST ID: ENST00000587924
  CDS Start-End: 129-329
ctcctaccggccagaaagacagcccatggtcaagtgtggctagaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtaaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtac

SEQ ID NO: 123200 - DNA, 677 bp, Homo sapiens
  Payload ID: 4192
  Gene Symbol: CELF4
  Gene Name: CUGBP, Elav-like family member 4
  ENST ID: ENST00000587819
  CDS Start-End: 216-677
gggaagatgcagggtggggagactccgcggagggagcaaaatagaaaagcaaagggaggtacgagaggcagacagccgggaacaccgagaggcagagaagctccgagaacagtgcacgggagagaaagagaggctgcgccttcctcacctactgcgagcgtgagtcagcgctgaaggcccagagcgcgctgcacgagcagaagactctgcccgggatgaaccggccgatccaggtgaagcctgcggacagcgagagccgaggagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatg

SEQ ID NO: 123201 - DNA, 1444 bp, Homo sapiens
  Payload ID: 4192
  Gene Symbol: CELF4
  Gene Name: CUGBP, Elav-like family member 4
  ENST ID: ENST00000588597
  CDS Start-End: 11-1375
gattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtcctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggtaatgtcatctcctcgaaagtgtttgtggatcgggcgactaaccaaagtaaatgctttggtgggtaaagataacaaaccaattagcttcacctaggacagggcggtgctcgcaccaacctaccggtgtccgactgc

SEQ ID NO: 123202 - DNA, 2651 bp, Homo sapiens
  Payload ID: 4192
  Gene Symbol: CELF4
  Gene Name: CUGBP, Elav-like family member 4
  ENST ID: ENST00000588591
  CDS Start-End: 1-456
gcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaaggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt
